(12) United States Patent
Matsuzaki et al.

(10) Patent No.: US 7,629,164 B2
(45) Date of Patent: Dec. 8, 2009

(54) METHODS FOR GENOTYPING POLYMORPHISMS IN HUMANS

(75) Inventors: Hajime Matsuzaki, Palo Alto, CA (US); Rui Mei, Santa Clara, CA (US)

(73) Assignee: Affymetrix, Inc., Santa Clara, CA (US)

( * ) Notice: Subject to any disclaimer, the term of this patent is extended or adjusted under 35 U.S.C. 154(b) by 789 days.

(21) Appl. No.: 10/891,260

(22) Filed: Jul. 13, 2004

(65) Prior Publication Data

US 2005/0227244 A1    Oct. 13, 2005

Related U.S. Application Data

(63) Continuation-in-part of application No. 10/681,773, filed on Oct. 7, 2003, now Pat. No. 7,300,788.

(60) Provisional application No. 60/417,190, filed on Oct. 8, 2002, provisional application No. 60/470,475, filed on May 14, 2003.

(51) Int. Cl.
   *C12M 1/34*    (2006.01)
   *C12M 3/00*    (2006.01)
   *C07H 21/04*   (2006.01)
   *C12Q 1/68*    (2006.01)

(52) U.S. Cl. .................. 435/287.2; 536/23.1; 536/24.3; 435/91.1

(58) Field of Classification Search ........................ None
See application file for complete search history.

(56) References Cited

U.S. PATENT DOCUMENTS

| 5,900,481 | A  | * | 5/1999  | Lough et al.   | ............... 536/55.3  |
| 6,358,686 | B1 | * | 3/2002  | Lemieux et al. | ................. 435/6   |
| 6,582,908 | B2 | * | 6/2003  | Fodor et al.   | ..................... 435/6 |
| 6,812,339 | B1 | * | 11/2004 | Venter et al.  | ............. 536/24.31   |

OTHER PUBLICATIONS

Affymetrix GeneChip Human Mapping 10K array (product Data Sheet, 2003; pp. 1-4).*
NEB catalog (1998/1999), pp. 121, 284.*
dbSNP build history.*
Carrasquillo, Minerva M., et al., Genome-wide association study and mouse model identify interaction between Ret and EDNRB pathways in Hirschsprung disease, Nature Genetics, Oct. 2002, pp. 237-244, vol. 32, Nature Publishing Group, New York, NY, USA.
Dalma-Weiszhausz, Dennise D., et al., Single nucleotide polymorphisms and their characterization with oligonucleotide microarrays, Psychiatric Genetics, 2002, pp. 97-107, vol. 12, No. 2, Lippincott Williams & Wilkins, Philadelphia, PA, USA.
Dong, Shoulian, et al., Flexible Use of High-Density Oligonucleotide Arrays for Single-Nucleotide Polymorphism Discovery and Validation, Genome Research, 2001, pp. 1418-1424, vol. 11, Cold Spring Harbor Laboratory Press, USA.
Dumur, Caterine I., et al., Genome-wide detection of LOH in prostate cancer using human SNP microarray technology, Genomics, 2003, pp. 260-269, vol. 81, Academic Press, USA.
Fan, Jian-Bing, et al., Paternal Origins of Complete Hydatidiform Moles Proven by Whole Genome Single-Nucleotide Polymorphism Haplotyping, Genomics, Jan. 2002, pp. 58-62, vol. 79, No. 1, Academic Press, USA.
Garcia, Christine Kim, et al., Sequence Diversity in Genes of Lipid Metabolism, Genome Research, 2001, pp. 1043-1052, vol. 11, Cold Spring Harbor Laboratory Press, USA.
Guo, Qingbin M., DNA Microarray and cancer, Current Opinion in Oncology, 2003, pp. 36-43, vol. 15, Lippincott Williams & Wilkins, Philadelphia, PA, USA.
Hacker, et al, Gut, 1997, vol. 40, pp. 623-627.
Halushka, Marc K., et al., Patterns of single-nucleotide polymorphisms in candidate genes for blood-pressure homeostasis, Nature Genetics, Jul. 1999, pp. 239-247, vol. 22, Nature America, Inc., USA.
Lindblad-Toh, Kerstin, et al., Loss-of-heterozgosity analysis of small-cell lung carcinomas using single-nucleotide polymorphism arrays, Nature Biotechnology, Sep. 2000, pp. 1001-1005, vol. 18, Nature Publishing Group, New York, NY, USA.
Lindblad-Toh, Kerstin, et al., Large-scale discovery and genotyping of single-nucleotide polymorphisms in the mouse, Nature Genetics, Apr. 2000, pp. 381-386, vol. 24, Nature America, Inc., USA.
Lindroos, Katarina, et al., Minisequencing on oligonucleotide microarrays: comparison of immobilisation chemistries, Nucleic Acids Research, 2001, pp. e69 (1-7), vol. 29, No. 13, Oxford University Press, UK.
Malhotra, et al, Am. J. of Psychiatry, vol. 161, pp. 780-796, May 2004.
Mei, Rui, et al., Genome-wide Detection of Allelic Imbalance Using Human SNPs and High-density DNA Arrays, Genome Research, 2000, pp. 1126-1137, vol. 10, No. 8, Cold Spring Harbor Laboratory Press, USA.
Pennisi, Science, 1998; 281 (5384): 1787-1789.
Schubert, Elizabeth L., et al., Single Nucleotide Polymorphism Array Analysis of Flow-Sorted Epithelial Cells from Frozen Versus Fixed Tissues for Whole Genome Analysis of Allelic Loss in Breast Cancer, American Journal of Pathology, Jan. 2002, pp. 73-79, vol. 160, No. 1, American Society for Investigative Pathology, USA.
Warrington, Janet a., et al., New Developments in High-Throughput Resequencing and Variation Detection Using High Density Microarrays, Human Mutation, 2002, pp. 402-409, vol. 19, No. 4, Wiley-Liss, Inc., USA.
Wilson, S.G., et al., Comparison of Genome Screens for Two Independent Cohorts Provides Replication of Suggestive Linkage of Bone Mineral Density to 3p21 and 1p36, American Journal of Human Genetics, 2003, pp. 144-155, vol. 72, No. 1, American Socity of Human Genetics, USA.
Zhou, Wei, Mapping genetic alterations in tumors with single nucleotide polymorphisms, Current Opinion in Oncology, 2003, pp. 50-54, vol. 15, No. 1, Lippincott Williams & Wilkins, Inc, Philadelphia, PA, USA.
Rubenstein, K, The Current State of the Biochip Business, Drug & Market Development, Nov. 1999, pp. 392-196, vol. 10, No. 11, Drug & Market Development Publications, USA.

* cited by examiner

*Primary Examiner*—Jehanne S Sitton
(74) *Attorney, Agent, or Firm*—Sandra E. Wells

(57) ABSTRACT

The invention provides nucleic acid sequences that are complementary, in one embodiment, to a collection of human single nucleotide polymorphisms. The invention provides the sequences in such a way as to make them available for a variety of analyses including genotyping a large number of SNPs in parallel by, for example, allele specific hybridization. The invention also provides a collection of human SNPs that is useful for genetic analysis within and across populations. As such, the invention relates to diverse fields impacted by the nature of genetics, including biology, medicine, and medical diagnostics.

6 Claims, No Drawings

METHODS FOR GENOTYPING POLYMORPHISMS IN HUMANS

RELATED APPLICATIONS

The present application claims priority to U.S. Provisional Application Nos. 60/417,190 filed Oct. 8, 2002 and 60/470,475 filed May 14, 2003 and is a continuation-in-part of U.S. patent application Ser. No. 10/681,773, now U.S. Pat. No. 7,300,788, filed Oct. 7, 2003, the disclosures of which are each incorporated herein by reference in their entireties.

FIELD OF THE INVENTION

The present invention provides pools of nucleic acid sequences and arrays of nucleic acid sequences that are useful for genotyping polymorphisms in nucleic acid samples derived from humans. The invention also provides a collection of SNPs that may be amplified reproducibly and genotyped in parallel using a single assay. The invention relates to diverse fields, including genetics, genomics, biology, population biology, medicine, and medical diagnostics.

REFERENCE TO SEQUENCE LISTING

The Sequence Listing submitted on compact disk is hereby incorporated by reference. The file on the disk is named 3522.3seqlist.txt, the file is 1.45 MB and the date of creation is Jul. 12, 2004.

BACKGROUND

The past years have seen a dynamic change in the ability of science to comprehend vast amounts of data. Pioneering technologies such as nucleic acid arrays allow scientists to delve into the world of genetics in far greater detail than ever before. Exploration of genomic DNA has long been a dream of the scientific community. Held within the complex structures of genomic DNA lies the potential to identify, diagnose, or treat diseases like cancer, Alzheimer disease or alcoholism. Exploitation of genomic information from plants and animals may also provide answers to the world's food distribution problems.

Recent efforts in the scientific community, such as the publication of the draft sequence of the human genome in February 2001, have changed the dream of genome exploration into a reality. Genome-wide assays, however, must contend with the complexity of genomes; the human genome for example is estimated to have a complexity of $3 \times 10^9$ base pairs. Novel methods of sample preparation and sample analysis that reduce complexity may provide for the fast and cost effective exploration of complex samples of nucleic acids, particularly genomic DNA.

Single nucleotide polymorphisms (SNPs) have emerged as the marker of choice for genome wide association studies and genetic linkage studies. Building SNP maps of the genome will provide the framework for new studies to identify the underlying genetic basis of complex diseases such as cancer, mental illness and diabetes. Due to the wide ranging applications of SNPs there is still a need for the development of robust, flexible, cost-effective technology platforms that allow for scoring genotypes in large numbers of samples.

SUMMARY OF THE INVENTION

The invention provides nucleic acid sequences that are complementary to particular regions of the human genome that are each known to contain a single nucleotide polymorphism. The invention further provides a collection of oligonucleotide probes that are useful for genotyping a selected set of SNPs found in the human genome. For example, in one embodiment the invention comprises an array comprising any 10 or more, 100 or more, 1000 or more, 10,000 or more, 100,000 or more, or 1,000,000 or more nucleic acid probes containing 15 or more consecutive nucleotides from the sequences listed in SEQ ID NOS: 1-10,204 or the complements thereof. Also contemplated are perfect match and mismatch probes that are subsequences of the sequences listed in SEQ ID Nos. 1-10,204 or the complements thereof. In a preferred embodiment the array comprises oligonucleotide probes that are 25 consecutive nucleotides from each of the sequences listed in SEQ ID NOS 1-10,204, each probe being a different 25 nucleotide sequence and each probe being attached to a solid support in a determinable position.

In a further embodiment, the invention comprises the use of any of the above arrays or fragments disclosed in SEQ ID NOS 1-10,204 to: monitor loss of heterozygosity; determine copy number, identify imprinted genes; genotype polymorphisms; determine allele frequencies in a population, characterize biallelic markers; produce genetic maps; detect linkage disequilibrium, determine allele frequencies, do association studies, analyze genetic variation, to identify markers linked to a phenotype or, compare genotypes between different individuals or populations. In a further embodiment the invention comprises a method of analysis comprising hybridizing one or more pools of nucleic acids to two or more probes, wherein the probes comprise at least 20 consecutive nucleotides from one of the sequences disclosed in SEQ ID NOS 1-10,204 and detecting said hybridization. In a further embodiment the invention comprises the use of any one or more 20 consecutive bases from one of the sequences disclosed in SEQ ID NOS 1-10,204 as a primer for PCR. Kits comprising collections of oligonucleotide probes are also disclosed. The oligonucleotide probes are perfectly complementary to one or the other allele of a selected SNP.

DETAILED DESCRIPTION OF THE INVENTION a) General

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series (Vols. I-IV)*, *Using Antibodies: A Laboratory Manual*, *Cells: A Laboratory Manual*, *PCR Primer: A Laboratory Manual*, and *Molecular Cloning: A Laboratory Manual* (all from Cold Spring Harbor Laboratory Press), Stryer, L. (1995) *Biochemistry* (4th Ed.) Freeman, N.Y., Gait, "*Oligonucleotide Synthesis: A Practical Approach*" 1984, *IRL Press, London*, Nelson and Cox (2000), *Lehninger, Principles of Biochemistry* $3^{rd}$ Ed., W.H. Freeman Pub., New York, N.Y. and Berg et al. (2002) *Biochemistry*, $5^{th}$ Ed., W.H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication No. WO 99/36760) and PCT/US01/04285 (International Publication No. WO 01/58593), which are all incorporated herein by reference in their entirety for all purposes.

Genotyping methods are disclosed in, for example, U.S. Pat. Nos. 5,925,525, 6,268,141, 6,267,152, 6,525,185, 6,632,611, 6,673,579, 6,361,947 and 6,300,063.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring and profiling methods can be shown in U.S. Pat. Nos. 5,800,992, 6,013,449, 6,020,135, 6,033,860, 6,040,138, 6,177,248 and 6,309,822. Genotyping and uses therefore are shown in U.S. Ser. Nos. 10/442,021, 10/013,598 (U.S. patent application Publication 20030036069), and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with genotyping, the genomic sample may be amplified by a variety of mechanisms, some of which may employ PCR. See, for example, *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); *PCR* (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. The sample may be amplified on the array. See, for example, U.S. Pat. No. 6,300,070 and U.S. Ser. No. 09/513,300, which are incorporated herein by reference.

Other suitable amplification methods include the ligase chain reaction (LCR) (for example, Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA*, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and in U.S. Ser. No. 09/854,317, each of which is incorporated herein by reference.

Additional methods of sample preparation and techniques for reducing the complexity of a nucleic sample are described in Dong et al., *Genome Research* 11, 1418 (2001), in U.S. Pat. Nos. 6,361,947, 6,391,592 and U.S. Ser. Nos. 09/916,135, 09/920,491 (U.S. patent application Publication 20030096235), Ser. No. 09/910,292 (U.S. patent application Publication 20030082543), and Ser. No. 10/013,598.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* ($2^{nd}$ Ed. Cold Spring Harbor, N.Y., 1989); Berger and Kimmel *Methods in Enzymology*, Vol. 152, *Guide to Molecular Cloning Techniques* (Academic Press, Inc., San Diego, Calif., 1987); Young and Davism, *P.N.A.S*, 80: 1194 (1983). Methods and apparatus for carrying out repeated and controlled hybridization reactions have been described in U.S. Pat. Nos. 5,871,928, 5,874,219, 6,045,996 and 6,386,749, 6,391,623 each of which are incorporated herein by reference The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. Ser. No. 10/389,194 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800,992, 5,834,758; 5,856,092, 5,902,723, 5,936,324, 5,981,956, 6,025,601, 6,090,555, 6,141,096, 6,185,030, 6,201,639; 6,218,803; and 6,225,625, in U.S. Ser. Nos. 10/389,194, 60/493,495 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, for example Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis *Bioinformatics: A Practical Guide for Analysis of Gene and Proteins* (Wiley & Sons, Inc., 2$^{nd}$ ed., 2001). See U.S. Pat. No. 6,420,108.

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

Additionally, the present invention may have preferred embodiments that include methods for providing genetic information over networks such as the Internet as shown in U.S. Ser. Nos. 10/197,621, 10/063,559 (U.S. Publication No. 20020183936), Ser. Nos. 10/065,856, 10/065,868, 10/328,818, 10/328,872, 10/423,403, and 60/482,389.

b) Definitions

The term "admixture" refers to the phenomenon of gene flow between populations resulting from migration. Admixture can create linkage disequilibrium (LD).

The term "allele" as used herein is any one of a number of alternative forms a given locus (position) on a chromosome. An allele may be used to indicate one form of a polymorphism, for example, a biallelic SNP may have possible alleles A and B. An allele may also be used to indicate a particular combination of alleles of two or more SNPs in a given gene or chromosomal segment. The frequency of an allele in a population is the number of times that specific allele appears divided by the total number of alleles of that locus.

The term "array" as used herein refers to an intentionally created collection of molecules which can be prepared either synthetically or biosynthetically. The molecules in the array can be identical or different from each other. The array can assume a variety of formats, for example, libraries of soluble molecules; libraries of compounds tethered to resin beads, silica chips, or other solid supports.

The term "biomonomer" as used herein refers to a single unit of biopolymer, which can be linked with the same or other biomonomers to form a biopolymer (for example, a single amino acid or nucleotide with two linking groups one or both of which may have removable protecting groups) or a single unit which is not part of a biopolymer. Thus, for example, a nucleotide is a biomonomer within an oligonucleotide biopolymer, and an amino acid is a biomonomer within a protein or peptide biopolymer; avidin, biotin, antibodies, antibody fragments, etc., for example, are also biomonomers.

The term "biopolymer" or sometimes refer by "biological polymer" as used herein is intended to mean repeating units of biological or chemical moieties. Representative biopolymers include, but are not limited to, nucleic acids, oligonucleotides, amino acids, proteins, peptides, hormones, oligosaccharides, lipids, glycolipids, lipopolysaccharides, phospholipids, synthetic analogues of the foregoing, including, but not limited to, inverted nucleotides, peptide nucleic acids, Meta-DNA, and combinations of the above.

The term "biopolymer synthesis" as used herein is intended to encompass the synthetic production, both organic and inorganic, of a biopolymer. Related to a bioploymer is a "biomonomer".

The term "combinatorial synthesis strategy" as used herein refers to a combinatorial synthesis strategy is an ordered strategy for parallel synthesis of diverse polymer sequences by sequential addition of reagents which may be represented by a reactant matrix and a switch matrix, the product of which is a product matrix. A reactant matrix is a l column by m row matrix of the building blocks to be added. The switch matrix is all or a subset of the binary numbers, preferably ordered, between l and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

The term "complementary" as used herein refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Alternatively, complementarity exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. See, M. Kanehisa Nucleic Acids Res. 12:203 (1984), incorporated herein by reference.

The term "effective amount" as used herein refers to an amount sufficient to induce a desired result.

The term "genome" as used herein is all the genetic material in the chromosomes of an organism. DNA derived from the genetic material in the chromosomes of a particular organism is genomic DNA. A genomic library is a collection of clones made from a set of randomly generated overlapping DNA fragments representing the entire genome of an organism.

The term "genotype" as used herein refers to the genetic information an individual carries at one or more positions in the genome. A genotype may refer to the information present at a single polymorphism, for example, a single SNP. For example, if a SNP is biallelic and can be either an A or a C then if an individual is homozygous for A at that position the genotype of the SNP is homozygous A or AA. Genotype may also refer to the information present at a plurality of polymorphic positions.

The term "Hardy-Weinberg equilibrium" (HWE) as used herein refers to the principle that an allele that when homozygous leads to a disorder that prevents the individual from reproducing does not disappear from the population but remains present in a population in the undetectable heterozygous state at a constant allele frequency.

The term "hybridization" as used herein refers to the process in which two single-stranded polynucleotides bind noncovalently to form a stable double-stranded polynucleotide; triple-stranded hybridization is also theoretically possible. The resulting (usually) double-stranded polynucleotide is a "hybrid." The proportion of the population of polynucleotides that forms stable hybrids is referred to herein as the "degree of hybridization." Hybridizations are usually performed under stringent conditions, for example, at a salt concentration of no more than about 1 M and a temperature of at least 25° C. Examples of hybridization conditions include: 5×SSPE (750 mM NaCl, 50 mM NaPhosphate, 5 mM EDTA, pH 7.4) and a temperature of 25-30° C. are suitable for allele-specific probe hybridizations or conditions of 100 mM MES, 1 M [Na$^+$], 20 mM EDTA, 0.01% Tween-20 and a temperature of 30-50° C., preferably at about 45-50° C. Hybridizations may be performed in the presence of agents such as herring sperm DNA at about 0.1 mg/ml, acetylated BSA at about 0.5 mg/ml. In a preferred embodiment 70 ul of labeled DNA is mixed with 190 ul of the following hybridization cocktail: 0.056 M MES, 5.0% DMSO, 2.50× Denhardt's Solution, 5.77 mM EDTA, 0.115 mg/mL Herring Sperm DNA (10 mg/mL), 11.5 µg/mL Human Cot-1, 0.0115% Tween-20, and 2.69 M (3%) TMACL and hybridized to a genotyping array at 16° C.

As other factors may affect the stringency of hybridization, including base composition and length of the complementary strands, presence of organic solvents and extent of base mismatching, the combination of parameters is more important than the absolute measure of any one alone. Hybridization conditions suitable for microarrays are described in the Gene Expression Technical Manual, 2004 and the GeneChip Mapping Assay Manual, 2004.

The term "hybridization probes" as used herein are oligonucleotides capable of binding in a base-specific manner to a complementary strand of nucleic acid. Such probes include oligonucleotides, peptide nucleic acids, as described in Nielsen et al., *Science* 254, 1497-1500 (1991), LNAs, as described in Koshkin et al. *Tetrahedron* 54:3607-3630, 1998, and U.S. Pat. No. 6,268,490 and other nucleic acid analogs and nucleic acid mimetics.

The term "hybridizing specifically to" as used herein refers to the binding, duplexing, or hybridizing of a molecule only to a particular nucleotide sequence or sequences under stringent conditions when that sequence is present in a complex mixture (for example, total cellular) DNA or RNA.

The term "initiation biomonomer" or "initiator biomonomer" as used herein is meant to indicate the first biomonomer which is covalently attached via reactive nucleophiles to the surface of the polymer, or the first biomonomer which is attached to a linker or spacer arm attached to the polymer, the linker or spacer arm being attached to the polymer via reactive nucleophiles.

The term "isolated nucleic acid" as used herein mean an object species invention that is the predominant species present (i.e., on a molar basis it is more abundant than any other individual species in the composition). Preferably, an isolated nucleic acid comprises at least about 50, 80 or 90% (on a molar basis) of all macromolecular species present. Most preferably, the object species is purified to essential homogeneity (contaminant species cannot be detected in the composition by conventional detection methods).

The term "ligand" as used herein refers to a molecule that is recognized by a particular receptor. The agent bound by or reacting with a receptor is called a "ligand," a term which is definitionally meaningful only in terms of its counterpart receptor. The term "ligand" does not imply any particular molecular size or other structural or compositional feature other than that the substance in question is capable of binding or otherwise interacting with the receptor. Also, a ligand may serve either as the natural ligand to which the receptor binds, or as a functional analogue that may act as an agonist or antagonist. Examples of ligands that can be investigated by this invention include, but are not restricted to, agonists and antagonists for cell membrane receptors, toxins and venoms, viral epitopes, hormones (for example, opiates, steroids, etc.), hormone receptors, peptides, enzymes, enzyme substrates, substrate analogs, transition state analogs, cofactors, drugs, proteins, and antibodies.

The term "linkage analysis" as used herein refers to a method of genetic analysis in which data are collected from affected families, and regions of the genome are identified that co-segregated with the disease in many independent families or over many generations of an extended pedigree. A disease locus may be identified because it lies in a region of the genome that is shared by all affected members of a pedigree.

The term "linkage disequilibrium" or sometimes referred to as "allelic association" as used herein refers to the preferential association of a particular allele or genetic marker with a specific allele, or genetic marker at a nearby chromosomal location more frequently than expected by chance for any particular allele frequency in the population. For example, if locus X has alleles A and B, which occur equally frequently, and linked locus Y has alleles C and D, which occur equally frequently, one would expect the combination AC to occur with a frequency of 0.25. If AC occurs more frequently, then alleles A and C are in linkage disequilibrium. Linkage disequilibrium may result from natural selection of certain combination of alleles or because an allele has been introduced into a population too recently to have reached equilibrium with linked alleles. The genetic interval around a disease locus may be narrowed by detecting disequilibrium between nearby markers and the disease locus. For additional information on linkage disequilibrium see Ardlie et al., *Nat. Rev. Gen.* 3:299-309, 2002.

The term "lod score" or "LOD" is the log of the odds ratio of the probability of the data occurring under the specific hypothesis relative to the null hypothesis. LOD=log [probability assuming linkage/probability assuming no linkage].

The term "mixed population" or sometimes refer by "complex population" as used herein refers to any sample containing both desired and undesired nucleic acids. As a non-limiting example, a complex population of nucleic acids may be total genomic DNA, total genomic RNA or a combination thereof. Moreover, a complex population of nucleic acids may have been enriched for a given population but include other undesirable populations. For example, a complex population of nucleic acids may be a sample which has been enriched for desired messenger RNA (mRNA) sequences but still includes some undesired ribosomal RNA sequences (rRNA).

The term "monomer" as used herein refers to any member of the set of molecules that can be joined together to form an oligomer or polymer. The set of monomers useful in the present invention includes, but is not restricted to, for the example of (poly)peptide synthesis, the set of L-amino acids, D-amino acids, or synthetic amino acids. As used herein, "monomer" refers to any member of a basis set for synthesis of an oligomer. For example, dimers of L-amino acids form a basis set of 400 "monomers" for synthesis of polypeptides. Different basis sets of monomers may be used at successive steps in the synthesis of a polymer. The term "monomer" also refers to a chemical subunit that can be combined with a different chemical subunit to form a compound larger than either subunit alone.

The term "mRNA" or sometimes refer by "mRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

The term "nucleic acid library" or sometimes refer by "array" as used herein refers to an intentionally created collection of nucleic acids which can be prepared either synthetically or biosynthetically and screened for biological activity in a variety of different formats (for example, libraries of soluble molecules; and libraries of oligos tethered to resin beads, silica chips, or other solid supports). Additionally, the term "array" is meant to include those libraries of nucleic acids which can be prepared by spotting nucleic acids of essentially any length (for example, from 1 to about 1000 nucleotide monomers in length) onto a substrate. The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "nucleic acids" as used herein may include any polymer or oligomer of pyrimidine and purine bases, preferably cytosine, thymine, and uracil, and adenine and guanine, respectively. See Albert L. Lehninger, PRINCIPLES OF BIOCHEMISTRY, at 793-800 (Worth Pub. 1982). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally-occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

The term "oligonucleotide" or sometimes refer by "polynucleotide" as used herein refers to a nucleic acid ranging from at least 2, preferable at least 8, and more preferably at least 20 nucleotides in length or a compound that specifically hybridizes to a polynucleotide. Polynucleotides of the present invention include sequences of deoxyribonucleic acid (DNA) or ribonucleic acid (RNA) which may be isolated from natural sources, recombinantly produced or artificially synthesized and mimetics thereof. A further example of a polynucleotide of the present invention may be peptide nucleic acid (PNA). The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

The term "polymorphism" as used herein refers to the occurrence of two or more genetically determined alternative sequences or alleles in a population. A polymorphic marker or site is the locus at which divergence occurs. Preferred markers have at least two alleles, each occurring at frequency of greater than 1%, and more preferably greater than 10% or 20% of a selected population. A polymorphism may comprise one or more base changes, an insertion, a repeat, or a deletion. A polymorphic locus may be as small as one base pair. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wildtype form. Diploid organisms may be homozygous or heterozygous for allelic forms. A diallelic polymorphism has two forms. A triallelic polymorphism has three forms. Single nucleotide polymorphisms (SNPs) are included in polymorphisms.

The term "primer" as used herein refers to a single-stranded oligonucleotide capable of acting as a point of initiation for template-directed DNA synthesis under suitable conditions for example, buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

The term "probe" as used herein refers to a surface-immobilized molecule that can be recognized by a particular target. See U.S. Pat. No. 6,582,908 for an example of arrays having all possible combinations of probes with 10, 12, and more bases. Examples of probes that can be investigated by this invention include, but are not restricted to, agonists and antagonists for cell membrane receptors, toxins and venoms, viral epitopes, hormones (for example, opioid peptides, steroids, etc.), hormone receptors, peptides; enzymes, enzyme substrates, cofactors, drugs, lectins, sugars, oligonucleotides, nucleic acids, oligosaccharides, proteins, and monoclonal antibodies.

The term "receptor" as used herein refers to a molecule that has an affinity for a given ligand. Receptors may be naturally-occurring or manmade molecules. Also, they can be employed in their unaltered state or as aggregates with other species. Receptors may be attached, covalently or noncovalently, to a binding member, either directly or via a specific binding substance. Examples of receptors which can be employed by this invention include, but are not restricted to, antibodies, cell membrane receptors, monoclonal antibodies and antisera reactive with specific antigenic determinants (such as on viruses, cells or other materials), drugs, polynucleotides, nucleic acids, peptides, cofactors, lectins, sugars, polysaccharides, cells, cellular membranes, and organelles. Receptors are sometimes referred to in the art as anti-ligands. As the term receptors is used herein, no difference in meaning is intended. A "Ligand Receptor Pair" is formed when two macromolecules have combined through molecular recognition to form a complex. Other examples of receptors which can be investigated by this invention include but are not restricted to those molecules shown in U.S. Pat. No. 5,143,854, which is hereby incorporated by reference in its entirety.

The term "solid support", "support", and "substrate" as used herein are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations. See U.S. Pat. No. 5,744,305 for exemplary substrates.

The term "target" as used herein refers to a molecule that has an affinity for a given probe. Targets may be naturally-occurring or man-made molecules. Also, they can be employed in their unaltered state or as aggregates with other species. Targets may be attached, covalently or noncovalently, to a binding member, either directly or via a specific binding substance. Examples of targets which can be employed by this invention include, but are not restricted to, antibodies, cell membrane receptors, monoclonal antibodies and antisera reactive with specific antigenic determinants (such as on viruses, cells or other materials), drugs, oligonucleotides, nucleic acids, peptides, cofactors, lectins, sugars, polysaccharides, cells, cellular membranes, and organelles. Targets are sometimes referred to in the art as anti-probes. As the term targets is used herein, no difference in meaning is intended. A "Probe Target Pair" is formed when two macromolecules have combined through molecular recognition to form a complex.

C. Interrogation of Selected Human SNPs

SEQ ID NOS 1-10,204, are disclosed. The sequences provided correspond to one strand of the genomic DNA including a SNP position and 16 bases 5' of the SNP position and 16 bases 3' of the SNP position. The polymorphic base is at position 17 of the sequence in the sequence listing. For example, SEQ ID No. 1 is 5'-agctgagcag aaagagKttg ggtct-tagtg tct-3' and the SNP position is represented by K. The symbols Y, K, M and R are used to represent the SNP position where Y is T or C, K is G or T, M is A or C, R is G or A, W is A or T and S is G or C. So, for SEQ ID NO 1 the SNP has alleles G and T. Each of SEQ ID Nos. 1-10,204 represents a single SNP from the human genome and 32 bases of sequence flanking each SNP. The sequences also represent a set of probes to genotype the corresponding SNP by allele specific hybridization. In a preferred embodiment the probes comprise 20 to 25 contiguous nucleotides from one of SEQ ID Nos. 1-10,204. SNPs were selected to be included in the list of SNPs and to be interrogated by the mapping array from public databases of SNPs such as dbSNP, The SNP Consortium (TSC) and from SNPs identified by Perlegen Sciences, Inc. SNPs were selected through a screening and validation process that evaluated accuracy of genotyping calls, rate of genotyping calls, and physical distribution in the genome.

The present invention includes: the sequences listed in SEQ ID Nos. 1-10,204 and probes comprising 11 to 33 contiguous bases of any of the sequences in SEQ ID Nos. 1-10, 204 or the complement thereof. In a preferred embodiment the probes comprise 20-25 contiguous bases of a sequence from SEQ ID Nos. 1-10,204 or the complement thereof. Also contemplated are corresponding mismatch probes that include a single base mismatch, preferably at a central position of the probe, and longer nucleotide sequences that comprise a contiguous subsequence of at least 15 bases of one of the sequences listed in SEQ ID Nos. 1-10,204.

The set of SNPs represented by SEQ ID Nos. 1-10,204 varies from the set disclosed in U.S. patent application Ser. No. 10/681,773 by removal of approximately 1400 of the SNPs disclosed in Ser. No. 10/681,773 and addition of 68 new SNPs, corresponding to SEQ ID Nos. 10,137-10,204. The 1400 SNPs were removed because they have lower call rates than the remaining SNPs or are close to another SNP in the set. The reduced number of probes required to genotype the reduced number of SNPs allows the probes of the array to be tiled in 8 μm² features on a 169 format array with array size about 7 μm² with more than 410,000 probes. The 68 new SNPs were selected to provide better SNP coverage on chromosomes 19 and the X chromosome. The probes of the array are allele specific so if the SNP is either T or a C then there is a probe or probe set that is complementary to the T allele and a probe or probe set that is complementary to the C allele and the probe for the T allele is in a different feature of the array than the probe for the C allele.

In a preferred embodiment the array comprises sets of probes to detect the SNPs represented by SEQ ID NOS 1-10, 204 or a subset of those SNPs. Arrays may detect at least 1,000, 5,000, or 10,000 of the selected SNPs. In one embodiment there are 40 probes for each SNP, comprising 10 quartets of 4 probes. Each quartet consists of a perfect match probe for allele A, a perfect match probe for allele B, a mismatch probe for allele A and a mismatch probe for allele B. The mismatch probe is identical to the perfect match probe with the exception that the central base in the mismatch probe, position 13 in a 25 nucleotide probe, is the complement of the perfect match base. For example, if the perfect match probe has a G at position 13 the mismatch probe has a C at that position. One quartet varies from another in the position of the polymorphic base, for example in one quartet the polymorphic base may be at the central or 0 position of the probe, which is the 13th nucleotide from the 5' end of a 25 nucleotide probe. In the other quartets the polymorphic base may be shifted 5' or 3' of the 0 position. Thus, each 33 nucleotide sequence in the sequence listing represents at least 40 different probes that contain at least 15 contiguous nucleotides of a sequence from the sequence listing. Preferably the probes are 25 contiguous nucleotides of a sequence from the sequence listing. A probe set that is exemplary of a probe set of a preferred genotyping array is shown in Table 1.

TABLE 1

| SEQ ID NO | PM/MM, A/G | Position | Probe Sequence | Strand |
|---|---|---|---|---|
| 10,205 | PM A | -4 | tcatttaacattTgtgTtaacaaaa | 0 |
| 10,206 | MM A | -4 | tcatttaacattAgtgTtaacaaaa | 0 |
| 10,207 | PM A | -2 | atttaacatttgTgTtaacaaaaac | 0 |
| 10,208 | MM A | -2 | atttaacatttgAgTtaacaaaaac | 0 |
| 10,209 | PM A | -1 | tttaacatttgtGTtaacaaaaact | 0 |
| 10,210 | MM A | -1 | tttaacatttgtCTtaacaaaaact | 0 |
| 10,211 | PM A | 0 | ttaacatttgtgTtaacaaaaactc | 0 |
| 10,212 | MM A | 0 | ttaacatttgtgAtaacaaaaactc | 0 |
| 10,213 | PM A | 1 | taacatttgtgTTaacaaaaactcc | 0 |
| 10,214 | MM A | 1 | taacatttgtgTAaacaaaaactcc | 0 |
| 10,215 | PM A | 4 | catttgtgTtaaCaaaaactcctcc | 0 |
| 10,216 | MM A | 4 | catttgtgTtaaGaaaaactcctcc | 0 |
| 10,217 | PM G | -4 | tcatttaacattTgtgCtaacaaaa | 0 |
| 10,218 | MM G | -4 | tcatttaacattAgtgCtaacaaaa | 0 |
| 10,219 | PM G | -2 | atttaacatttgTgCtaacaaaaac | 0 |
| 10,220 | MM G | -2 | atttaacatttgAgCtaacaaaaac | 0 |
| 10,221 | PM G | -1 | tttaacatttgtGCtaacaaaaact | 0 |
| 10,222 | MM G | -1 | tttaacatttgtCCtaacaaaaact | 0 |
| 10,223 | PM G | 0 | ttaacatttgtgCtaacaaaaactc | 0 |
| 10,224 | MM G | 0 | ttaacatttgtgGtaacaaaaactc | 0 |
| 10,225 | PM G | 1 | taacatttgtgCTaacaaaaactcc | 0 |
| 10,226 | MM G | 1 | taacatttgtgCAaacaaaaactcc | 0 |
| 10,227 | PM G | 4 | catttgtgCtaaCaaaaactcctcc | 0 |
| 10,228 | MM G | 4 | catttgtgCtaaGaaaaactcctcc | 0 |
| 10,229 | PM A | -4 | ttttgttaAcacAaatgttaaatga | 1 |
| 10,230 | MM A | -4 | ttttgttaAcacTaatgttaaatga | 1 |
| 10,231 | PM A | -2 | gtttttgttaAcAcaaatgttaaat | 1 |
| 10,232 | MM A | -2 | gtttttgttaAcTcaaatgttaaat | 1 |
| 10,233 | PM A | -1 | agtttttgttaACacaaatgttaaa | 1 |
| 10,234 | MM A | -1 | agtttttgttaAGacaaatgttaaa | 1 |
| 10,235 | PM A | 0 | gagtttttgttaAcacaaatgttaa | 1 |
| 10,236 | MM A | 0 | gagtttttgttaTcacaaatgttaa | 1 |
| 10,237 | PM G | -4 | ttttgttaGcacAaatgttaaatga | 1 |
| 10,238 | MM G | -4 | ttttgttaGcacTaatgttaaatga | 1 |
| 10,239 | PM G | -2 | gtttttgttaGcAcaaatgttaaat | 1 |
| 10,240 | MM G | -2 | gtttttgttaGcTcaaatgttaaat | 1 |
| 10,241 | PM G | -1 | agtttttgttaGCacaaatgttaaa | 1 |
| 10,242 | MM G | -1 | agtttttgttaGGacaaatgttaaa | 1 |
| 10,243 | PM G | 0 | gagtttttgttaGcacaaatgttaa | 1 |
| 10,244 | MM G | 0 | gagtttttgttaCcacaaatgttaa | 1 |

The exemplary probe set shown in Table 1 has 40 probes. There are 10 sets of 4 probes. Each set has 2 perfect match probes, 1 for each allele (PM A and PM G) and 2 mismatch probes (MM A and MM G). In this set there are 24 probes, (6 probe sets), for the 0 strand and 16 probes, (4 probe sets), for the 1 strand. The probe sets for the 0 strand correspond to the SNP allele at positions -4, -2, -1, 0, 1 and 4 and the probe sets for the 1 strand correspond to the SNP allele at positions -4, -2, -1 and 0. As shown by this example there can be an unequal number of probe sets for the 0 and 1 strand. PM A indicates perfect match probes for allele A and PM G indicates perfect match probes for allele G. Mismatch probes for allele A and G are indicated by MM A and MM G, respectively. The strands are indicated by 0 or 1, where 0 and 1 are complementary strands of a double stranded DNA.

In a preferred embodiment the optimal 10 quartets are selected for each SNP. This may be 5 quartets for each of the two strands or an unequal number of quartets from each strand, for example 6 from one strand and 4 for the other as in the example in Table 1. There may be 7 and 3, 8 and 2, 9 and 1 or 10 and 0. For example, the 5 quartets may be 0, +2, +4, -3, and −4 on one strand and 0, +1, +3, −2, and −4 on the opposite strand. In some embodiments the quartets for one strand correspond to the quartets from the other strand so that the probes from one quartet are the complements of the probes from the corresponding quartet.

The central position, which varies between PM and MM, and the allele specific position, which varies between PM A and PM G, are capitalized in Table 1. For example, Table 1 SEQ ID No. 10,205 has a T at position 13 and a T at position 17 and is the PM A probe. SEQ ID No. 10,206 has an A at position 13 and a T at position 17. Position 13 is the position of the mismatch base and position 17 is the position of the allele specific SNP base. The SNP position is shifted to the −4 position relative to the 0 strand. The −4 G allele probes are SEQ ID Nos. 10,217 and 10,218 and they have a C at position 17. The −4 probes for the A allele for the 1 strand, the opposite strand, are SEQ ID Nos. 10,229 and 10,230. The mismatch is at position 13 and the SNP allele is at position 9.

Accordingly, for each nucleic acid sequence listed in SEQ ID NOS 1-10,204, this disclosure includes a probe comprising any contiguous length of from 15 to 33 nucleotides, preferably between 20 and 25 nucleotides, from a sequence in the list or the complement of a sequence in the list. The oligonucleotides may also comprise any contiguous length from 15 to 33 nucleotides from a sequence in the list or the complement of a sequence in the list including a single base mismatch. The position of the mismatch is preferably located at the central position of the probe, for example, for a probe of 25 nucleotides, the mismatch position would be position 13. In another embodiment the mismatch position may be located anywhere in the nucleic acid sequence and may comprise one or more bases. Generally the sequences correspond to SNPs represented by SEQ ID Nos. 1-10,204 which include the SNP position and sequences surrounding the SNP. The SNPs are preferably biallelic but may be triallelic and the probes in a preferred embodiment are used to distinguish between different alleles of a SNP. Frequency of SNPs vary between populations so a SNP that is biallelic in one population may not be polymorphic in another population or may be represented by different alleles.

The present invention includes: the sequences listed in SEQ ID NOS 1-10,204 and the complement of these sequences as well as mismatch probes, longer nucleotide sequences which include the nucleic acid sequences listed in SEQ ID NOS 1-10,204 and the complement of these sequences and sub-sequences greater than 9 nucleotides in length of the target nucleic acid sequences listed in SEQ ID NOS 1-10,204 and the complement of these sequences. Also disclosed are oligonucleotides that comprise 15 to 33 contiguous nucleotides from one of the sequences in SEQ ID No. 1-10,204 or the complement of SEQ ID No. 1-10,204 and additional sequence 5' or 3'. For example, oligonucleotides or probes may comprise one or more tag sequences, universal priming sequence, or restriction enzyme recognition sequences upstream or downstream of a region comprising 15 to 33 contiguous nucleotides of SEQ ID No. 1-10,204. The oligonucleotides may be attached to a solid support, for example, each different sequence may be attached to one or more beads. In one embodiment an oligonucleotide that is complementary to each allele of each of the SNPs represented by SEQ ID No. 1-10,204 is attached to an array in a determinable location that is different from a plurality of other different sequence oligonucleotides. The oligonucleotides may be extended in an allele specific manner and extension detected. For example, extension may be with labeled nucleotides and may also be allele specific. Differently tagged oligos may be used for each allele of each SNP. See, for example, U.S. Pat. Nos. 6,709,816, 6,287,778, and 6,638,719.

SNPs were selected from the publicly available database of human SNPs. The selected SNPs are from the group of SNPs that are present on XbaI fragments of 250 to 2000 base pairs. A computer system was used to predict fragments that would result when the human genome is digested with XbaI. In some embodiments the present invention provides a pool of unique nucleotide sequences complementary to SNPs and sequence surrounding SNPs which alone, or in combinations of 2 or more, 10 or more, 100 or more, 1,000 or more, 10,000 or more, 100,000 or more or 400,000 or more, can be used for a variety of applications. In a preferred embodiment an array comprising allele specific probes for each allele of each SNP represented by SEQ ID Nos. 1-10,204 is disclosed. The probes are preferably present at a feature density of greater than 400,000 probes per cm2 and more preferably each different probe is present in a feature that is about 8 μm×8 μm or smaller.

In one embodiment, the present invention provides for a pool of unique nucleotide sequences which are complementary to Human SNPs and sequence surrounding SNPs formed into a high density array of probes suitable for array based massive parallel gene expression. Array based methods for SNP analysis and genotyping are disclosed and discussed in detail in U.S. Pat. Nos. 6,361,947 and 6,368,799 which are incorporated herein by reference for all purposes. Generally those methods of SNP analysis involve: (1) providing a pool of target nucleic acids comprising one or more target sequence(s), (2) amplifying a collection of target sequences, (3) hybridizing the amplified nucleic acid sample to a high density array of probes, and (4) detecting the hybridized nucleic acids and determining the presence or absence of one or more alleles for one or more SNPs.

The development of Very Large Scale Immobilized Polymer Synthesis or VLSIPS™ technology has provided methods for making very large arrays of nucleic acid probes in very small arrays. See U.S. Pat. No. 5,143,854 and PCT Nos. WO 90/15070 and 92/10092, and Fodor et al., Science, 251:767-77 (1991), each of which is incorporated herein by reference. U.S. Pat. Nos. 5,800,992 and 6,040,138 describe methods for making arrays of nucleic acid probes that can be used to detect the presence of a nucleic acid containing a specific nucleotide sequence. Methods of forming high-density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling.

In one embodiment probes are present on the array so that each SNP is represented by a collection of probes. The array may comprise between 4 and 80 probes for each SNP. In one embodiment the collection comprises, between 20 and 40 probes for each SNP. In another embodiment the array comprises about 40 to about 56 probes for each SNP. In a preferred embodiment the collection comprises about 40 probes for each SNP, 20 for each allele. In one embodiment the probes may be present in sets of 8 probes that correspond to a PM probe for each of two alleles, a MM probe for each of 2 alleles, and the corresponding probes for the opposite strand. In another embodiment the probes may be present in sets of 4 probes that correspond to a PM probe for each of two alleles and a MM probe for each of 2 alleles. For each allele there may be a perfect match, a perfect mismatch, an antisense match and an antisense mismatch probe. The polymorphic position may be the central position of the probe region, for example, the probe region may be 25 nucleotides and the polymorphic allele may be in the middle with 12 nucleotides on either side. In other probe sets the polymorphic position may be offset from the center. For example, the polymorphic position may be from 1 to 7 bases from the central position on either the 5' or 3' side of the probe. The interrogation position, which is changed in the mismatch probes, may remain at the center position. In one embodiment there are 56 probes for each SNP: the 8 probes corresponding to the polymorphic position at the center or 0 position and 8 probes for the polymorphic position at each of the following positions: −4, −2, −1, +1, +3 and +4 relative to the central or 0 position. In another embodiment 40 probes are used, 8 for the 0 position and 8 for each of 4 additional positions selected from: −4, −2, −1, +1, +3 and +4 relative to the central or 0 position. The probes sets used may vary depending on the SNP, for example, for one SNP the probes may be −4, −2, 0, +1 and +4 and for another SNP they may be −2, −1, 0, +1 and +4. Empirical data may be used to choose which probe sets to use on an array. In another embodiment 24 or 32 probes may be used for one or more SNPs.

In many embodiments pairs are present in perfect match and mismatch pairs, one probe in each pair being a perfect match to the target sequence and the other probe being identical to the perfect match probe except that the central base is a homo-mismatch. Mismatch probes provide a control for non-specific binding or cross-hybridization to a nucleic acid in the sample other than the target to which the probe is directed. Thus, mismatch probes may be used to indicate whether hybridization is or is not specific. For example, if the target is present, the perfect match probes should be consistently brighter than the mismatch probes because fluorescence intensity, or brightness, corresponds to binding affinity. (See e.g., U.S. Pat. No. 5,324,633 and PCT No. WO 98/11223 which are incorporated herein for all purposes.

In another embodiment, the current invention may be combined with known methods to genotype polymorphism in a wide variety of contexts. For example, the methods may be used to do association studies, identify candidate genes associated with a phenotype, genotype SNPs in clinical populations, or correlate genotype information to clinical phenotypes. The SNPs of represented by SEQ ID Nos. 1-10,204 have been selected based on a number of criteria that make them suitable for complex genetic analysis, for example, linkage analysis and association studies. The SNPs are spaced throughout the genome at an average distance of 210 Kb from one another and they are known to be polymorphic in multiple populations. The panel of SNPs or a subset of these SNPs may be genotyped by any method available. See, Color Atlas of Genetics ($2^{nd}$ ed), Ed. Passarge (2001) Thieme, NY, N.Y., which is incorporated by reference.

For a discussion of genotyping analysis methods see, for example, Elena and Lenski Nature Reviews, Genetics 4:457-469 (2003), Twyman and Primrose, Pharmacogenomics 4:67-79 (2003), Hirschhorn et al. Genetics in Medicine 4:45-61 (2002) and Glazier et al. *Science* 298:2345-2349 (2002) each of which is incorporated herein by references for all purposes. For a discussion of high throughput genotyping approaches see, for example, Jenkins and Gibson, *Comp Funct Genom* 2002; 3:57-66 which is incorporated herein by reference. For a review of methods of haplotype analysis in population genetics and association studies see, for example, Zhao et al. Pharmacogenomics 4:171-178 (2003), which is incorporated herein by reference.

One skilled in the art will appreciate that a wide range of applications will be available using 2 or more, 10 or more, 100 or more, 1000 or more, 10,000 or more, 100,000 or more, or more of the SEQ ID NOS 1-10,204 sequences as probes for polymorphism detection and analysis. The combination of the DNA array technology and the Human SNP specific probes in this disclosure is a powerful tool for genotyping and mapping disease loci.

In many embodiments the target sequences are a subset that is representative of a larger set. For example, the target sequences may be at least 1,000, 5,000, 10,000 or 100,000 to 10,000, 20,000, 100,000, 1,500,000 or 3,000,000 SNPs that may be representative of a larger population of SNPs present in a population of individuals. The target sequences may be dispersed throughout a genome, including for example, sequences from each chromosome, or each arm of each chromosome. Target sequences may be representative of haplotypes or particular phenotypes or collections of phenotypes. For a description of haplotypes see, for example, Gabriel et al., *Science*, 296:2225-9 (2002), Daly et al. *Nat Genet.*, 29:229-32 (2001) and Rioux et al., *Nat Genet.*, 29:223-8 (2001), each of which is incorporated herein by reference in its entirety.

In another embodiment, the present invention may be used for cross-species comparisons. One skilled in the art will appreciate that it is often useful to determine whether a SNP present in one species, for example human, is present in a conserved format in another species, including, without limitation, gorilla, chimp, mouse, rat, chicken, zebrafish, *Drosophila*, or yeast. See e.g. Andersson et al., *Mamm. Genome*, 7(10):717-734 (1996), which is hereby incorporated by reference for all purposes, which describes the utility of cross-species comparisons. The use of 2 or more, 10 or more, 100 or more, 1000 or more, 10,000 or more, 100,000 or more of the sequences disclosed in this invention in an array can be used to determine whether any sequence from one or more of the Human genes represented by the sequences disclosed in this invention is conserved in another species by, for example, hybridizing genomic nucleic acid samples from another species to an array comprised of the sequences disclosed in this invention.

In another embodiment of the invention, the sequences of this invention and arrays comprising probes comprising the disclosed sequences and fragments thereof, may be used to generate primers directed to their corresponding genes as disclosed in the GenBank, dbSNP or any other public database. The sequences provided in the sequence listing may be used to identify the region of the genome containing the associated SNP and the frequency of each allele in a given population. Primers may be used in such basic techniques as sequencing or PCR, see e.g., Sambrook, incorporated by reference above. In one embodiment PCR is allele specific.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. The label may be, for example, fluorescent or chemiluminescent. Thus, for example, polymerase chain reaction (PCR) with labeled primers or labeled nucleotides will provide a labeled amplification product. In another embodiment, transcription amplification using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example, nick translation or end-labeling (e.g. with a labeled RNA) by kinasing the nucleic acid and subsequent attachment (ligation) of a nucleic acid linker joining the sample nucleic acid to a label (e.g., a fluorophore). In another embodiment label is added to the end of fragments using terminal deoxytransferase (TdT).

Detectable labels suitable for use in the present invention include any composition detectable by spectroscopic, photochemical, biochemical, immunochemical, electrical, optical or chemical means. Useful labels in the present invention include, but are not limited to: biotin for staining with labeled streptavidin conjugate; anti-biotin antibodies, magnetic beads (e.g., Dynabeads™); fluorescent dyes (e.g., fluorescein, texas red, rhodamine, green fluorescent protein, and the like); radiolabels (e.g., $^3H$, $^{125}I$, $^{35}S$, $^{14}C$, or $^{32}P$); phosphorescent labels; enzymes (e.g., horse radish peroxidase, alkaline phosphatase and others commonly used in an ELISA); and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters; fluorescent markers may be detected using a photodetector to detect emitted light. Enzymatic labels are typically detected by providing the enzyme with a substrate and detecting the reaction product produced by the action of the enzyme on the substrate, and calorimetric labels are detected by simply visualizing the colored label.

D. Methods of Use

The disclosed arrays, sequences and probes can be used for a wide variety of applications including, for example, linkage and association studies, identification of candidate gene regions, genotyping clinical populations, correlation of genotype information to phenotype information, loss of heterozygosity analysis, copy number analysis and identification of the source of an organism or sample, or the population from which an organism or sample originates. Any analysis of genomic DNA may be benefited by a reproducible method of polymorphism analysis. Furthermore, the probes, sequences, arrays and collections of SNPs of the presently claimed invention are particularly well suited for study and characterization of human genomic samples from individuals and populations.

In a preferred embodiment, the disclosed arrays, sequences and probes are used to genotype individuals, populations or samples. For example, any of the procedures described above, alone or in combination, could be used to interrogate SNPs in the collection. The disclosed arrays could be used in conjunction with methods of reducing the complexity of a sample in a reproducible and predictable manner. For example, complexity reduction methods may be designed to amplify a collection of target sequences that correspond to fragments containing SNPs from the sequence listing. Genotyping assays may be designed to interrogate the genotypes of each of the SNPs represented by a sequence in SEQ ID Nos. 1-10,204. The assay or assays may be used to genotype the SNPs in a plurality of individuals to determine allele frequency and association of alleles with particular phenotypes. Methods of use for polymorphisms and SNP discovery can be found in, for example, U.S. Pat. No. 6,361,947 which is herein incorporated by reference in its entirety for all purposes.

The disclosed collection of SNPs may be used for a variety of genetic analysis methods, for example, linkage studies, association studies, pharmacogenomics analysis, forensics, paternity testing, determination of relatedness, anthropological studies, and copy number analysis.

EXAMPLE

The following example serves to illustrate the type of experiment that could be conducted using the invention.

Polymorphism Detection by Hybridization to High Density Oligonucleotide Arrays

Arrays containing the desired number of probes can be synthesized using the method described in U.S. Pat. No. 5,143,854, incorporated by reference above. An exemplary array, the Mapping 10K 2.0 (Xba 142) array may be purchased from Affymetrix, Inc., Santa Clara.

Genomic DNA was digested with XbaI by mixing 5 μl 50 ng/μl human genomic DNA (Coriell Cell Repositories) with 10.5 μl H$_2$O (Accugene), 2 μl 10× RE buffer 2 (NEB, Beverly, Mass.), 2 μl 10×BSA (NEB, Beverly, Mass.), and 0.5 μl of 0.5 U/μl XbaI (NEB, Beverly, Mass.). The reaction was incubated at 30° C. for 2 hours, then the enzyme was inactivated by incubation at 70° C. for 20 min and then to 4° C. The reaction may be stored at −20° C. The reaction was performed in a 96 well plate and incubations were performed in a thermal cycler.

For ligation of the adapters the digested DNA was then mixed with 1.25 μl 5 μM adaptor in TE pH 8.0, 2.5 μl T4 DNA ligation buffer and 1.25 μl T4 DNA Ligase (NEB, Beverly, Mass.) which is added last. The reaction was incubated at 16° C. for 2 hours then at 70° C. for 20 min and then to 4° C. The 25 μl ligation mixture is then diluted with 75 μl H$_2$O and may be stored at −20° C.

For PCR 10 μl of the diluted ligated DNA is mixed with 10 μl PCR buffer II (Applied Biosystems), 10 μl (2.5 mM each) dNTP (PanVera Takara, Madison, Wis.), 10 μl 25 mM MgCl$_2$, 7.5 μl 10 μM primer (for a final concentration of 0.75 μM), 2 μl 5 U/μl AmpliTaq Gold® (Applied Biosystems) and 50.5 μl H$_2$O. For each array four 100 μl reactions were prepared. Amplification was done using the following program: 95° C. for 3 min; 35 cycles of 95° C. for 20 sec, 59° C. for 15 sec and 72° C. for 15 sec; and a final incubation at 72° C. for 7 min. The reactions were then held at 4° C. The lid heating option was selected.

The PCR reactions were then purified by mixing the 100 μl PCR reaction with 500 μl PB or PM buffer into Qiagen columns (Valencia, Calif.) and the column was centrifuged at 13,000 rpm for 1 min. Flow through was discarded and 750 μl PE buffer with ethanol was added into the column to wash the sample and the column was spun at 13,000 rpm for 1 min. The flow through was discarded and the column was spun at 13,000 rpm for another 1 min. The flow through was discarded and the column was placed in a new collection tube. For 2 of the 4 samples 30 μl of EB elution buffer pH 8.5 was added to the center of the QIAquick membrane to elute the sample and the columns were allowed to stand at room temperature for 5 min and then centrifuged at 13,000 for 1 min. The elution buffer from the first 2 samples was then used to elute the other 2 samples and the eluates were combined. The DNA was quantified and diluted so that 48 μl contains 20 μg DNA.

The DNA was fragmented by mixing 48 μl DNA (20 μg), 5 μl RE Buffer 4, and 2 μl 0.09 U/μl DNase in a total volume of 55 μl. The reaction was incubated at 37° C. for 30 min then 95° C. for 15 min and then held at 4° C.

Fragments were labeled by incubating 50 μl fragmented DNA, 13 μl 5×TdT buffer (Promega, Madison, Wis.), 1 μl 1 mM biotinolated-ddATP (NEN Life Sciences, Boston, Mass.), and 1 μl TdT (Promega, Madison, Wis.) at 37° C. overnight then at 95° C. for 10 min, then held at 4° C.

Hybridization mix is 12 μl 1.22 M MES, 13 μl DMSO, 13 μl 50× Denharts, 3μl 0.5M EDTA, 3 μl 10 mg/ml herring sperm DNA, 3 μl 10 nM oligo B2, μl 1 mg/ml Human Cot-1, 3 μl 1% Tween-20, and 140 μl 5M TMACL. 70 μl labeled DNA was mixed with 190 μl hybridization mix. The mixture was incubated at 95° C. for 10 min, spun briefly and held at 47.5° C. 200 μl of the denatured mixture was hybridized to an array at 47.5° C. for 16 to 18 hours at 60 rpm. The array comprised SEQ ID NOS. 1-10,204 tiled on an array along with mismatch, antisense match and antisense mismatch probes for each of the sequences. Each probe is present in a spatially addressable location.

Staining mix was 990 μl H₂O, 450 μl 20×SSPE, 15 μl Tween-20, 30 μl 50% Denharts. For the first stain mix 495 μl staining mix with 5 μl 1 mg/ml streptavidin (Pierce Scientific, Rockford, Ill.), for the second stain mix 495 μl staining mix with 5 μl 0.5 mg/ml biotinylated anti-streptavidin antibody (Vector Labs, Burlingame, Calif.) and for the third stain mix 495 μl staining mix with 5 μl 1 mg/ml streptavidin, R-phycoerythrin conjugate (Molecular Probes, Eugene, Oreg.). Wash and stain under standard conditions.

Hybridized samples were analyzed with a computer system to determine which alleles were present for a particular SNP. See also, the GeneChip® Mapping 10K 2.0 Assay Manual, Rev 1, 2004.

To prepare multiple samples simultaneously the PCR reactions may be performed in multiwell plates. PCR purification and elution of reactions performed in 96 well plates may be performed using the QIAGEN Min Elute 96 UF PCR purification plate as follows. Connect a vacuum manifold to a vacuum source so that ~800 mbar is maintained. Place a waste tray inside base of the manifold. Place a MinElute 96 UF PCR Purification Plate on top of the manifold. Cover wells that are not needed with PCR plate cover. Consolidate 4 PCR reactions for each sample into one well of the plate. Apply vacuum and maintain ~800 mbar until the wells are completely dry, about 90 minutes for 400 μl sample. Wash the PCR products with 50 μl water and dry the wells completely. Repeat 2 times for a total of 3 water washes. Turn off vacuum and remove plate. Tap the plate to remove any liquid that may remain on the bottom of the plate. Add 40 μl EB buffer to each well and cover the plate with PCR plate cover film. Shake the plate for 5 minutes moderately. Recover the PCR product by pipetting the eluate out of each well.

Quantify and normalize PCR product and transfer 20 μg of each sample in 45 μl EB buffer to new plate for fragmentation. Add 5 μl 10× fragmentation buffer to each sample on ice and vortex for 2 seconds. Add 5 μl of diluted fragmentation reagent (0.48 U/μl) to each reaction. Vortex for 1 minute, incubate 30 min at 37° C., 15 min at 95° C. and hold at 4° C.

Mix 14 μl 5×TdT buffer, 2 μl GeneChip DNA Labeling Reagent (5 nM) and 3.4 μl TdT (30 U/μl) with 50.6 μl fragmented DNA reaction. Seal the plate with a plate cover, vortex 2 minutes, incubate at 37° C. for 2 hours, 95° C. for 15 minutes and hold at 4° C. Mix the labeled DNA with 190 μl Hybridization Mix and denature at 95° C. for 10 minutes. Inject 80 μl into the array and hybridize at 48° C. for 16 to 18 hours at 60 rpm. Wash, stain and scan according to the manufacturers instructions, see GeneChip Mapping 10K 2.0 Assay Manual.

CONCLUSION

The inventions herein provide a pool of unique nucleic acid sequences, which may be used to genotype a collection of Human SNPs. These sequences can be used for a variety of types of analyses.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

SEQUENCE LISTING (10244 sequences)

SEQ ID NO: 1 - DNA, 33 bp, homo sapien
agctgagcagaaagagkttgggtcttagtgtct

SEQ ID NO: 2 - DNA, 33 bp, homo sapien
attagcttctaggtgtkcctgctgagtagatga

SEQ ID NO: 3 - DNA, 33 bp, homo sapien
gaagcgcgcatgcaatrgatccagggtgtatgc

SEQ ID NO: 4 - DNA, 33 bp, homo sapien
acgtagtcaacagtttrtgtgcaactcaacagg

SEQ ID NO: 5 - DNA, 33 bp, homo sapien
tctgcagttggagaatrcaaggtggatggtctg

SEQ ID NO: 6 - DNA, 33 bp, homo sapien
atgggttacaatttgtyatcttgataagaaggc

SEQ ID NO: 7 - DNA, 33 bp, homo sapien
taactaattgctataaygaatctaaagtattaa

SEQ ID NO: 8 - DNA, 33 bp, homo sapien
tctgctggctgctgggygttctcctggatggga

SEQ ID NO: 9 - DNA, 33 bp, homo sapien
agcctaatagtaaagtyggagttctttggcttt

SEQ ID NO: 10 - DNA, 33 bp, homo sapien
tgacacaaaatcaagaygagagccactcctcca

SEQ ID NO: 11 - DNA, 33 bp, homo sapien
atggagagagtgactaygtcaggcagcaagcaa

SEQ ID NO: 12 - DNA, 33 bp, homo sapien
cctgcagtttttcttayaccatctcagtctctt

SEQ ID NO: 13 - DNA, 33 bp, homo sapien
ccaccatattcagctaktcttgctatacgttat

SEQ ID NO: 14 - DNA, 33 bp, homo sapien
caagcccttcgaagagsaacatcagacctgcta

SEQ ID NO: 15 - DNA, 33 bp, homo sapien
agcttattaaaacaackttaggctccaccccta

SEQ ID NO: 16 - DNA, 33 bp, homo sapien
ttattataagacttagygtggcaacaaaggagc

SEQ ID NO: 17 - DNA, 33 bp, homo sapien
cctgcctcctcaatccrggtctctgcaggctgg

SEQ ID NO: 18 - DNA, 33 bp, homo sapien
caatttgcattaaaaastaaaaaacagatagag

SEQ ID NO: 19 - DNA, 33 bp, homo sapien
tattttaaagaattgaygaaggaaaattacaaa

SEQ ID NO: 20 - DNA, 33 bp, homo sapien
ctggtggagggtatctratagaagcatcttagt

SEQ ID NO: 21 - DNA, 33 bp, homo sapien
caataaaccacttatcygagtctgctcatctct

SEQ ID NO: 22 - DNA, 33 bp, homo sapien
tgtattgcagggagttkgtatgacactgtcttc

SEQ ID NO: 23 - DNA, 33 bp, homo sapien
atgttctgtttaatgakagtgatgcagtagggt

SEQ ID NO: 24 - DNA, 33 bp, homo sapien
gtttgtttcctgagacmactcctggtgataatt

SEQ ID NO: 25 - DNA, 33 bp, homo sapien
ttattttctcaatcttyaaatgagtctgatgaa

SEQ ID NO: 26 - DNA, 33 bp, homo sapien
agtgtatgaacttcatkgtcttcagaataaaac

SEQ ID NO: 27 - DNA, 33 bp, homo sapien
cttgagttatctttackcaacagcatcattttg

SEQ ID NO: 28 - DNA, 33 bp, homo sapien
agctgtagaaatgtacsaggtaatcatcaatat

SEQ ID NO: 29 - DNA, 33 bp, homo sapien
aagagattcatggtcaytgagttccttggagcc

SEQ ID NO: 30 - DNA, 33 bp, homo sapien
gttaggaaagctgcaawggcaaattgaaattca

SEQ ID NO: 31 - DNA, 33 bp, homo sapien
aacaatggtaaagctcyttggtctctggagaac

SEQ ID NO: 32 - DNA, 33 bp, homo sapien
aggtaagtgaactgaawgctcagtccaagtcta

SEQ ID NO: 33 - DNA, 33 bp, homo sapien
cgctgttagccgaatgycctcaagagcttcaga

SEQ ID NO: 34 - DNA, 33 bp, homo sapien
catttctttattgaaayggcaactcctcataac

SEQ ID NO: 35 - DNA, 33 bp, homo sapien
ttagtaaagttagaggmaatttcagctcctttt

SEQ ID NO: 36 - DNA, 33 bp, homo sapien
gctacttgattttttcrgttaccggcattctcc

SEQ ID NO: 37 - DNA, 33 bp, homo sapien
gcactctcccagcttcygctaatacatgttgat

SEQ ID NO: 38 - DNA, 33 bp, homo sapien
ccaaatagttggagccwcaatagaactgcgtta

SEQ ID NO: 39 - DNA, 33 bp, homo sapien
gaagatacaaagtgaakagtaaatcagtgagga

SEQ ID NO: 40 - DNA, 33 bp, homo sapien
gtacaggaaggctgttyctaaatggactggatt

SEQ ID NO: 41 - DNA, 33 bp, homo sapien
ttggtgtctaggttaarcaactcaagtatacat

SEQ ID NO: 42 - DNA, 33 bp, homo sapien
cctgacctctgaggaaytgaatgccagggtaag

SEQ ID NO: 43 - DNA, 33 bp, homo sapien
attaggcttgctcgctsgctctctctcaaacaa

SEQ ID NO: 44 - DNA, 33 bp, homo sapien
ggactagggcattagayagattacccacaaggg

SEQ ID NO: 45 - DNA, 33 bp, homo sapien
acaacagtggtagacaygaaaatgggaaggttt

SEQ ID NO: 46 - DNA, 33 bp, homo sapien
ctcttgggacactgacrgccagacttataccct

SEQ ID NO: 47 - DNA, 33 bp, homo sapien
ggaagccagagatgackcttcacattctccctt

SEQ ID NO: 48 - DNA, 33 bp, homo sapien
gctacttagactgagtraaagtattgctgaata

SEQ ID NO: 49 - DNA, 33 bp, homo sapien
aagagaatatactcacrggctccagggttaagg

SEQ ID NO: 50 - DNA, 33 bp, homo sapien
atctcagaacactagcrgcgagaaagagtgaga

SEQ ID NO: 51 - DNA, 33 bp, homo sapien
ttttctattgtgtatgwttttaactgtgggctt

SEQ ID NO: 52 - DNA, 33 bp, homo sapien
catgggcttccactcamcaaggctgacttggct

SEQ ID NO: 53 - DNA, 33 bp, homo sapien
tgcttttcagtttaatrgctgagaaataagtat

SEQ ID NO: 54 - DNA, 33 bp, homo sapien
gtttagctcccattttkaagagagaacattggt

SEQ ID NO: 55 - DNA, 33 bp, homo sapien
gataagttctgccatcytgaggctaattttata

SEQ ID NO: 56 - DNA, 33 bp, homo sapien
agccgattagggcagcrataccaattggaacaa

SEQ ID NO: 57 - DNA, 33 bp, homo sapien
tattatcaaccatgaawataaagtgggctcctt

SEQ ID NO: 58 - DNA, 33 bp, homo sapien
gtagaccagagaagatrttgaagccatggaggg

SEQ ID NO: 59 - DNA, 33 bp, homo sapien
taatatattcagcattrttcaagcagctaatta

SEQ ID NO: 60 - DNA, 33 bp, homo sapien
ttccgcttgaaaatagscaaaaagtctactgtg

SEQ ID NO: 61 - DNA, 33 bp, homo sapien
tggatatgttcattttwtgtgagcaaatgggag

SEQ ID NO: 62 - DNA, 33 bp, homo sapien
gccaaaccaaatgcttraagtttcaaatgcttt

SEQ ID NO: 63 - DNA, 33 bp, homo sapien
tgaattgaccattaccrttaccattaccctagc

SEQ ID NO: 64 - DNA, 33 bp, homo sapien
attcaataatgcatgayaaatggcctgtaaact

SEQ ID NO: 65 - DNA, 33 bp, homo sapien
ctgcaagggcttcttcytcaaatatgttatgat

SEQ ID NO: 66 - DNA, 33 bp, homo sapien
aaacattgattacctgrgttgcaaaaagaaata

SEQ ID NO: 67 - DNA, 33 bp, homo sapien
gtttcttctgtttttcyctctttatttgtaaac

SEQ ID NO: 68 - DNA, 33 bp, homo sapien
acataatttgttttagyacctgatttagtcact

SEQ ID NO: 69 - DNA, 33 bp, homo sapien
ctaacctcagtacagtstaggagagaactatgc

SEQ ID NO: 70 - DNA, 33 bp, homo sapien
taaataaacatggtagrttggagtaagttcttt

SEQ ID NO: 71 - DNA, 33 bp, homo sapien
catttggaatacaataraatgcttgcacttgag

SEQ ID NO: 72 - DNA, 33 bp, homo sapien
caaggctttcagcactsaatcagctctctccct

SEQ ID NO: 73 - DNA, 33 bp, homo sapien
gatgagtgttagagtcsagagatcatgggccta

SEQ ID NO: 74 - DNA, 33 bp, homo sapien
aatatgaatttattgcmacactgtgagtttccc

SEQ ID NO: 75 - DNA, 33 bp, homo sapien
cagggtttggctgccasttgcttataaatagat

SEQ ID NO: 76 - DNA, 33 bp, homo sapien
tgtgcaaggaccaaagraggaacctaaggagct

SEQ ID NO: 77 - DNA, 33 bp, homo sapien
tccctctcttatgatgrggaaagtttgaagcca

SEQ ID NO: 78 - DNA, 33 bp, homo sapien
atatccacaatctacaragtgctgaaacaaatc

SEQ ID NO: 79 - DNA, 33 bp, homo sapien
aggggctgaaagttatygccaatagccagtgat

SEQ ID NO: 80 - DNA, 33 bp, homo sapien
taggcttagcaatctgyagtttcacccctcgcc

SEQ ID NO: 81 - DNA, 33 bp, homo sapien
ccatggcaagccttgaygggagagccaattcgg

SEQ ID NO: 82 - DNA, 33 bp, homo sapien
ttaagaaaaaacatctwtcagcataactgagac

SEQ ID NO: 83 - DNA, 33 bp, homo sapien
accaggtcatttatttstcagcctgatgataga

SEQ ID NO: 84 - DNA, 33 bp, homo sapien
ggagtcagcatacccawcctgaaagaatctaaa

SEQ ID NO: 85 - DNA, 33 bp, homo sapien
caaattgctgagaaaayaagtaagttacagttt

SEQ ID NO: 86 - DNA, 33 bp, homo sapien
gctagactttattggaratgtagtccttgtcct

SEQ ID NO: 87 - DNA, 33 bp, homo sapien
aagacagtctcatacaygcaattgtgtgaagaa

SEQ ID NO: 88 - DNA, 33 bp, homo sapien
gagctaggggcagaagsaatgatcttccacatt

SEQ ID NO: 89 - DNA, 33 bp, homo sapien
gcttgatatgtgtactygtttcctggattgaag

SEQ ID NO: 90 - DNA, 33 bp, homo sapien
tagaatatatgagcaamtgaatccaagtatata

SEQ ID NO: 91 - DNA, 33 bp, homo sapien
cctctggattggaagtrctctgcatcttgaata

SEQ ID NO: 92 - DNA, 33 bp, homo sapien
tggtgctgcattttgtsaaacattcatgcgtgt

SEQ ID NO: 93 - DNA, 33 bp, homo sapien
atgccaattatagaacmaaatttaagaaaactg

SEQ ID NO: 94 - DNA, 33 bp, homo sapien
gtcattttgtctttcayaattgcctagaaacca

SEQ ID NO: 95 - DNA, 33 bp, homo sapien
ctagttgcacacaaagkcccaggaatcagaatg

SEQ ID NO: 96 - DNA, 33 bp, homo sapien
atgcttcttttctacamcttacactacaccaac

SEQ ID NO: 97 - DNA, 33 bp, homo sapien
accaggattcagaggakgtatcaaaaagtctgg

SEQ ID NO: 98 - DNA, 33 bp, homo sapien
aacttctgattaggtgycttttcattcaatctg

SEQ ID NO: 99 - DNA, 33 bp, homo sapien
aattaccaaacttcacyatgatagcacaaaagc

SEQ ID NO: 100 - DNA, 33 bp, homo sapien
taaagtatgttgttctrgcaccatgcatggact

SEQ ID NO: 101 - DNA, 33 bp, homo sapien
tacaaaagagctattasgttgtgaagaaatttc

SEQ ID NO: 102 - DNA, 33 bp, homo sapien
ttaccacttcacaactrcagagtaacctagatg

SEQ ID NO: 103 - DNA, 33 bp, homo sapien
tcttgttatgtcttcargctcacccatcttttc

SEQ ID NO: 104 - DNA, 33 bp, homo sapien
ttcccttagcatatgaytgtctctattatatgc

SEQ ID NO: 105 - DNA, 33 bp, homo sapien
gagattgagaacctctrctctaggagaaaagcc

SEQ ID NO: 106 - DNA, 33 bp, homo sapien
caagaccgaactggaaygggcttttggctagta

SEQ ID NO: 107 - DNA, 33 bp, homo sapien
ggctaatcactattggmaagggcctccgaacag

SEQ ID NO: 108 - DNA, 33 bp, homo sapien
ttacaataacagaaaakctcttgtgagggaaaa

SEQ ID NO: 109 - DNA, 33 bp, homo sapien
gtaaacatggaaattaygggtagaaattgagat

SEQ ID NO: 110 - DNA, 33 bp, homo sapien
gccctgcatggcggagsttggttttcccaccag

SEQ ID NO: 111 - DNA, 33 bp, homo sapien
aaaagaactgaaaaaawgtcctgaaattgctat

SEQ ID NO: 112 - DNA, 33 bp, homo sapien
gctgagagacagttccyagctacattgtatttc

SEQ ID NO: 113 - DNA, 33 bp, homo sapien
ccagaacagtaagaaayaacataatgaagacta

SEQ ID NO: 114 - DNA, 33 bp, homo sapien
atgctgtttgggatacrctgtgcttcctagatc

SEQ ID NO: 115 - DNA, 33 bp, homo sapien
ttgctagtgtctgctamcaaaatgtcggtgacc

SEQ ID NO: 116 - DNA, 33 bp, homo sapien
tcagaaagaatacccaragaaaccatgaaatct

SEQ ID NO: 117 - DNA, 33 bp, homo sapien
ttcagagcattagatasaaagaggccttaaaag

SEQ ID NO: 118 - DNA, 33 bp, homo sapien
aaagttcagatggtcarcaacttcatattgaca

SEQ ID NO: 119 - DNA, 33 bp, homo sapien
gtcttcatgtgatgacygggaaatttaagagca

SEQ ID NO: 120 - DNA, 33 bp, homo sapien
aggggatataggagtargttctgagcatgcagt

SEQ ID NO: 121 - DNA, 33 bp, homo sapien
tgcaaatttctaggagwgtagggagaaaatctt

SEQ ID NO: 122 - DNA, 33 bp, homo sapien
catttttaaacacggcrcttttggccaccagta

SEQ ID NO: 123 - DNA, 33 bp, homo sapien
gccaagtttatttgtartcaagagtggccgctc

SEQ ID NO: 124 - DNA, 33 bp, homo sapien
tacctttcatcttaccygcacatggctaccagg

SEQ ID NO: 125 - DNA, 33 bp, homo sapien
gaagatatactcatctmgccacaggtatgctgg

SEQ ID NO: 126 - DNA, 33 bp, homo sapien
gaaataacactcttgtkcagtaagcgttcagta

SEQ ID NO: 127 - DNA, 33 bp, homo sapien
ggtgatatataggttgrcttagctttgttcatc

SEQ ID NO: 128 - DNA, 33 bp, homo sapien
ggagaagaaatggtaamgtgggatgccaagtta

SEQ ID NO: 129 - DNA, 33 bp, homo sapien
ggcaggccttgtagaayatgttgaagatttggt

SEQ ID NO: 130 - DNA, 33 bp, homo sapien
tgaaaactgagacttaygagattcgcttggaaa

SEQ ID NO: 131 - DNA, 33 bp, homo sapien
aacggaaattccacccrccaaggagaagcagtt

SEQ ID NO: 132 - DNA, 33 bp, homo sapien
tgttatttgaattattscagtccatagaaaaag

SEQ ID NO: 133 - DNA, 33 bp, homo sapien
tccatatcacatgcatyctcacatgcacaatcc

SEQ ID NO: 134 - DNA, 33 bp, homo sapien
cacaaatctgaatttawtccatatgagcacggt

SEQ ID NO: 135 - DNA, 33 bp, homo sapien
tgtgttcataatttcckgtatggtttaagccct

SEQ ID NO: 136 - DNA, 33 bp, homo sapien
tgcaatatgttcagtgycttgaaataaaactaa

SEQ ID NO: 137 - DNA, 33 bp, homo sapien
aatttctatgcctgagwttgagaagggaacaag

SEQ ID NO: 138 - DNA, 33 bp, homo sapien
aagatggcatggagcawagcagagaactcctgg

SEQ ID NO: 139 - DNA, 33 bp, homo sapien
gagaaaagcctagtctyaacacatgaggaataa

SEQ ID NO: 140 - DNA, 33 bp, homo sapien
tccttctaagtgctgcraaaacactggacatta

SEQ ID NO: 141 - DNA, 33 bp, homo sapien
taagaatcatccaaccrtaattgtctaaacttc

SEQ ID NO: 142 - DNA, 33 bp, homo sapien
tggaaaacacctgagtmatacagtgaccaaagc

SEQ ID NO: 143 - DNA, 33 bp, homo sapien
gttgctactttggtgayatttgttatgcagaag

SEQ ID NO: 144 - DNA, 33 bp, homo sapien
agagttttattcgctgyttcatctcccctgtga

SEQ ID NO: 145 - DNA, 33 bp, homo sapien
ttttctgtggttcttcrcccagacataatcccc

SEQ ID NO: 146 - DNA, 33 bp, homo sapien
catagaccctagaatcrtgctggaccacagtag

SEQ ID NO: 147 - DNA, 33 bp, homo sapien
aattgaaagccttaacmatagattagaccaagc

SEQ ID NO: 148 - DNA, 33 bp, homo sapien
gctgaagcagaaatcarttatgcctgtgttgtt

SEQ ID NO: 149 - DNA, 33 bp, homo sapien
ctgtctctcatctattyatgaatttcctttcag

SEQ ID NO: 150 - DNA, 33 bp, homo sapien
gtcctcgtgtcaaaaayagcacaccagtgggtt

SEQ ID NO: 151 - DNA, 33 bp, homo sapien
agtttcagcctctcagygatctctcgtcagttt

SEQ ID NO: 152 - DNA, 33 bp, homo sapien
ttgctctggctggaccrtgctaagcagacagtc

SEQ ID NO: 153 - DNA, 33 bp, homo sapien
tcccaataccaacaggrgcaagaagtttattct

SEQ ID NO: 154 - DNA, 33 bp, homo sapien
ggtttggtttatggagmcctggctaaggagcat

SEQ ID NO: 155 - DNA, 33 bp, homo sapien
cctattgcagtaaccaygatggcagctggccct

SEQ ID NO: 156 - DNA, 33 bp, homo sapien
agggaggatggaaatakcaaacaaacaacaatg

SEQ ID NO: 157 - DNA, 33 bp, homo sapien
agagaaaataaaggaakttggtaagagatggat

SEQ ID NO: 158 - DNA, 33 bp, homo sapien
aaaataataagcagtamagatggaatcaggaac

SEQ ID NO: 159 - DNA, 33 bp, homo sapien
tttggagatttagaaastgtaggattacataaa

SEQ ID NO: 160 - DNA, 33 bp, homo sapien
aattttttccaaaacgygtaaatcatctattga

SEQ ID NO: 161 - DNA, 33 bp, homo sapien
taccggaccgtcctagytccagagctcccagtg

SEQ ID NO: 162 - DNA, 33 bp, homo sapien
agaactcacatcagtakaaagagcgctggattt

SEQ ID NO: 163 - DNA, 33 bp, homo sapien
tggagcatggtatcaastgttcagatagctctt

SEQ ID NO: 164 - DNA, 33 bp, homo sapien
tccggtacaatgcagcrtattaaaattgcctct

SEQ ID NO: 165 - DNA, 33 bp, homo sapien
ccccacgatttctactyagcttcaaactctcag

SEQ ID NO: 166 - DNA, 33 bp, homo sapien
aaaccctcctacctagwgcttcgccctcatcac

SEQ ID NO: 167 - DNA, 33 bp, homo sapien
tctattagaagagaaawgtctgcctttgacaat

SEQ ID NO: 168 - DNA, 33 bp, homo sapien
cataaatgcctcctaakgatttagctgtgctct

SEQ ID NO: 169 - DNA, 33 bp, homo sapien
aggcaagaatagacccrttgcttcaaatcccag

SEQ ID NO: 170 - DNA, 33 bp, homo sapien
tagagcagagaccttgrtttttgttaagagtga

SEQ ID NO: 171 - DNA, 33 bp, homo sapien
ggttcattcagaagagkcactgagggtaatctg

SEQ ID NO: 172 - DNA, 33 bp, homo sapien
gaaactgttaccagcaytagcggatgtgaaaaa

SEQ ID NO: 173 - DNA, 33 bp, homo sapien
actcataagatcaataycaatgtatctcatata

SEQ ID NO: 174 - DNA, 33 bp, homo sapien
gcttgggtgtcagcccyacagaggagaagggga

SEQ ID NO: 175 - DNA, 33 bp, homo sapien
ataaaataatatagatkgacgaaggggacaaag

SEQ ID NO: 176 - DNA, 33 bp, homo sapien
gaattttgtaattttcrttgctctccttgagct

SEQ ID NO: 177 - DNA, 33 bp, homo sapien
gataaaaatctctgccytcgtcgatcttacatt

SEQ ID NO: 178 - DNA, 33 bp, homo sapien
atcatctttcaaacagrgaatcagaatcaccac

SEQ ID NO: 179 - DNA, 33 bp, homo sapien
aattgactgaaatgaayctttctaaactttaca

SEQ ID NO: 180 - DNA, 33 bp, homo sapien
aacataagtgtccaggmgctggctgagtaggga

SEQ ID NO: 181 - DNA, 33 bp, homo sapien
agcaccagtatagaagraaaaacgcaggcttca

SEQ ID NO: 182 - DNA, 33 bp, homo sapien
agtgaaatcacatctgrtacagaagctgcaatt

SEQ ID NO: 183 - DNA, 33 bp, homo sapien
cagtgggtgaaaaggaygctatgtgctgggcaa

SEQ ID NO: 184 - DNA, 33 bp, homo sapien
taagtataagagtgaaytagaaataaaccaaac

SEQ ID NO: 185 - DNA, 33 bp, homo sapien
attactttgtttgactrgttctcattcaatatt

SEQ ID NO: 186 - DNA, 33 bp, homo sapien
gtacgccctcttcatgsatctttaattcaattt

SEQ ID NO: 187 - DNA, 33 bp, homo sapien
acgagactgtgttgaamgtaatgaaaaggcctg

SEQ ID NO: 188 - DNA, 33 bp, homo sapien
taaggattaagcataaygataaatgaaggtaca

SEQ ID NO: 189 - DNA, 33 bp, homo sapien
actcctaacctagtgaygaattagtaatattgt

SEQ ID NO: 190 - DNA, 33 bp, homo sapien
acagatacctgtgtccmtgtaagttatttagcc

SEQ ID NO: 191 - DNA, 33 bp, homo sapien
ttatatcagtgaagttmatcgtgccccaaaaca

SEQ ID NO: 192 - DNA, 33 bp, homo sapien
ttcttgacacgcatgaygagtgagtgctcttgg

SEQ ID NO: 193 - DNA, 33 bp, homo sapien
aaggggctggacagackatttccagggatcgcc

SEQ ID NO: 194 - DNA, 33 bp, homo sapien
attaggcaagtctgatmtttggttatgatgaag

SEQ ID NO: 195 - DNA, 33 bp, homo sapien
tttgccaagaatatcakgttttattgcattttt

SEQ ID NO: 196 - DNA, 33 bp, homo sapien
gggagagaacatgctgycactgagatgttgaca

SEQ ID NO: 197 - DNA, 33 bp, homo sapien
ctactcagagggttgcrttgcatgtcagtatgt

SEQ ID NO: 198 - DNA, 33 bp, homo sapien
aagctgctgccttatgracaagtaagaggaaat

SEQ ID NO: 199 - DNA, 33 bp, homo sapien
gcctttttccttcatcrgcatatatgcaaagag

SEQ ID NO: 200 - DNA, 33 bp, homo sapien
ggtcctcaggatgggtrcaatgaagcagagtga

SEQ ID NO: 201 - DNA, 33 bp, homo sapien
agggaataaacgtagcyggtaagcctgagtatc

SEQ ID NO: 202 - DNA, 33 bp, homo sapien
cttcgcaaagccacagrcactgtaaccttggtg

SEQ ID NO: 203 - DNA, 33 bp, homo sapien
acagataggcaatggtrtgaaagttggcttcac

SEQ ID NO: 204 - DNA, 33 bp, homo sapien
aattcatgccaagttgmagaagcagacaaaatg

SEQ ID NO: 205 - DNA, 33 bp, homo sapien
cagtgtcactgcagccrgatccctaaccccatt

SEQ ID NO: 206 - DNA, 33 bp, homo sapien
aagccaggcttaaaaayaaattacacgcctctg

SEQ ID NO: 207 - DNA, 33 bp, homo sapien
tccctgcatctgtactrtatctttatcactgaa

SEQ ID NO: 208 - DNA, 33 bp, homo sapien
attgtgctaaagttaargcaatatgcaatctgg

SEQ ID NO: 209 - DNA, 33 bp, homo sapien
actttaacttaaggttytcaatcggtgtacagt

SEQ ID NO: 210 - DNA, 33 bp, homo sapien
ctacttgcattcatctraacatttttaaatttc

SEQ ID NO: 211 - DNA, 33 bp, homo sapien
tttattgtgcatgtccrtcctccatatttattc

SEQ ID NO: 212 - DNA, 33 bp, homo sapien
accagaaacaattaacmatatggcgttaacaaa

SEQ ID NO: 213 - DNA, 33 bp, homo sapien
attgagcatttaacccsttggtgatgaattcag

SEQ ID NO: 214 - DNA, 33 bp, homo sapien
ttttttttgaatgcatrtaaagcacttaatcag

SEQ ID NO: 215 - DNA, 33 bp, homo sapien
tggcacgcagagattargaagtgactgtccatt

SEQ ID NO: 216 - DNA, 33 bp, homo sapien
agaaagaataccttttkatagaagacacgttta

SEQ ID NO: 217 - DNA, 33 bp, homo sapien
gagatcaaatgataatwcaagctcataaaagag

SEQ ID NO: 218 - DNA, 33 bp, homo sapien
gcaccaaagaacatatrtataaaggaccttgag

SEQ ID NO: 219 - DNA, 33 bp, homo sapien
agcgtgaaagagaagasctaagatgaacaaatg

SEQ ID NO: 220 - DNA, 33 bp, homo sapien
gagaagaaagagggcaygcgagtcccactcctc

SEQ ID NO: 221 - DNA, 33 bp, homo sapien
aggctagcccaaattgytgacccataaaatcat

SEQ ID NO: 222 - DNA, 33 bp, homo sapien
tctggtcagaaacctartttttgtgctggccaa

SEQ ID NO: 223 - DNA, 33 bp, homo sapien
ggacatgttttttagtsagggtgaatggagaag

SEQ ID NO: 224 - DNA, 33 bp, homo sapien
aatttaggatgtcttcrtttaattcactgctaa

SEQ ID NO: 225 - DNA, 33 bp, homo sapien
atgctaagatagggcaygaccgaacttggtttg

SEQ ID NO: 226 - DNA, 33 bp, homo sapien
agcacacctgctaacaktacccatggtaataaa

SEQ ID NO: 227 - DNA, 33 bp, homo sapien
cttgaatatgttgggcyacgtgacaaacatgga

SEQ ID NO: 228 - DNA, 33 bp, homo sapien
ctaaacacagagccaarggctgcatgacctaca

SEQ ID NO: 229 - DNA, 33 bp, homo sapien
gcaatgtctctttctgraacatgtatctggctg

SEQ ID NO: 230 - DNA, 33 bp, homo sapien
ttcaagaaaggagtaarcggtcctttcacaggt

SEQ ID NO: 231 - DNA, 33 bp, homo sapien
tctgtactctcacgacrcattgtatgtatccag

SEQ ID NO: 232 - DNA, 33 bp, homo sapien
ccttctgccactttctstcggtgctaatggatg

SEQ ID NO: 233 - DNA, 33 bp, homo sapien
ggcatgtttaaattgtygtaatctgagtgagtg

SEQ ID NO: 234 - DNA, 33 bp, homo sapien
tcttcgaatgtttggcrtggtgctagttatgag

SEQ ID NO: 235 - DNA, 33 bp, homo sapien
ttccagattggcttgarcagagaggttgaagaa

SEQ ID NO: 236 - DNA, 33 bp, homo sapien
agagtactatttgcttraaaaggaatgcaaata

SEQ ID NO: 237 - DNA, 33 bp, homo sapien
aggtcagtgagatgcgractaaaagggctcact

SEQ ID NO: 238 - DNA, 33 bp, homo sapien
gataggcttttttccamgttagtttctgaaaag

SEQ ID NO: 239 - DNA, 33 bp, homo sapien
tcaaactccctggcctrgtatttaaggtgttct

SEQ ID NO: 240 - DNA, 33 bp, homo sapien
ccttctgaatggactayataacttgggtgaaaa

SEQ ID NO: 241 - DNA, 33 bp, homo sapien
caagagcaagttgtttrgttttcatatatttgt

SEQ ID NO: 242 - DNA, 33 bp, homo sapien
gccatcttttgctttartagtaaggtgaaagcc

SEQ ID NO: 243 - DNA, 33 bp, homo sapien
tccagcaatagcatctraagacaatatatgaaa

SEQ ID NO: 244 - DNA, 33 bp, homo sapien
atataagcatttaaatraagtgcagataggaac

SEQ ID NO: 245 - DNA, 33 bp, homo sapien
aagaaaaaggaagggaygagaccaaaaagaaaa

SEQ ID NO: 246 - DNA, 33 bp, homo sapien
aagtgtcagctgtagayctctctgaatagtgtg

SEQ ID NO: 247 - DNA, 33 bp, homo sapien
gctgaaagcacagtgcmgaaatggttatattta

SEQ ID NO: 248 - DNA, 33 bp, homo sapien
actgtggtcacacttcyggacagcaaatgggga

SEQ ID NO: 249 - DNA, 33 bp, homo sapien
cacttgtgaaatttgaycactaatgcaataatc

SEQ ID NO: 250 - DNA, 33 bp, homo sapien
agagtccctggagggtygtgaatagcagtgccc

SEQ ID NO: 251 - DNA, 33 bp, homo sapien
gcaacacgggaattgasaggagagttgcttcaa

SEQ ID NO: 252 - DNA, 33 bp, homo sapien
aaataggttcacaggaygtcaaggctattatat

SEQ ID NO: 253 - DNA, 33 bp, homo sapien
agctataagaacctaaycgtagaagatcagctc

SEQ ID NO: 254 - DNA, 33 bp, homo sapien
gacttcttagagaagckagtcttttttgaatgg

SEQ ID NO: 255 - DNA, 33 bp, homo sapien
gggaagtgtgtaaaatrccaggctgctctccct

SEQ ID NO: 256 - DNA, 33 bp, homo sapien
agcatggtgggatgagwaggagttggtgactaa

SEQ ID NO: 257 - DNA, 33 bp, homo sapien
gaaaagatcatgatcgkgtaaagagattgattc

SEQ ID NO: 258 - DNA, 33 bp, homo sapien
ggtctttaatccagccmatgtcatttcccaaaa

SEQ ID NO: 259 - DNA, 33 bp, homo sapien
gactgatgacttgaacrtttcccaagtttggca

SEQ ID NO: 260 - DNA, 33 bp, homo sapien
catcagtttaatcaaaycaacaagcatttattg

SEQ ID NO: 261 - DNA, 33 bp, homo sapien
atcctttcctcccaccsagaatagtaccatcag

SEQ ID NO: 262 - DNA, 33 bp, homo sapien
gcccacagctataggtkactagatgttcgagct

SEQ ID NO: 263 - DNA, 33 bp, homo sapien
acatttcttttcaactrtgtgtttaaatctgga

SEQ ID NO: 264 - DNA, 33 bp, homo sapien
ttcctttcttcattttktgagttttcttagttt

SEQ ID NO: 265 - DNA, 33 bp, homo sapien
aaatgtatttgcatacytatagctctttctgtt

SEQ ID NO: 266 - DNA, 33 bp, homo sapien
tctttaaaaatgattakcagagtctattgaaat

SEQ ID NO: 267 - DNA, 33 bp, homo sapien
tgtccaatatttatcaygtcttggtgtttcact

SEQ ID NO: 268 - DNA, 33 bp, homo sapien
atatccagcttctcaaygtgttacttgtctcat

SEQ ID NO: 269 - DNA, 33 bp, homo sapien
cagcagttgctcttccwctgatctctcaagaag

SEQ ID NO: 270 - DNA, 33 bp, homo sapien
caggttgtcatcttggracacatgaacatggca

SEQ ID NO: 271 - DNA, 33 bp, homo sapien
attcaggaaatgtataygcccgcttagctccaa

SEQ ID NO: 272 - DNA, 33 bp, homo sapien
atccccacattgcagtracttaacacaacaaag

SEQ ID NO: 273 - DNA, 33 bp, homo sapien
tctaagacaaattaaayctctgacttcccttga

SEQ ID NO: 274 - DNA, 33 bp, homo sapien
ggagaagagattttgarggagcaagactggaag

SEQ ID NO: 275 - DNA, 33 bp, homo sapien
cacattctcactttgtyctcactcggtctttcc

SEQ ID NO: 276 - DNA, 33 bp, homo sapien
gagtctggtaaacctayaaaaacttgcaaatca

SEQ ID NO: 277 - DNA, 33 bp, homo sapien
catagagggatataagmggaaattttaaaatac

SEQ ID NO: 278 - DNA, 33 bp, homo sapien
tgacatgcctggtgcckcacttgctgggtttta

SEQ ID NO: 279 - DNA, 33 bp, homo sapien
tctggacacagagcggygctgccaccacagcag

SEQ ID NO: 280 - DNA, 33 bp, homo sapien
ctttcactttcttaacrgtgttttttgaatcac

SEQ ID NO: 281 - DNA, 33 bp, homo sapien
ccacctatttactaacyattcaatccctttact

SEQ ID NO: 282 - DNA, 33 bp, homo sapien
ataatgatgctcatcaractgttatttataata

SEQ ID NO: 283 - DNA, 33 bp, homo sapien
tcagtgagctatgtatyttctgctaatttgaat

SEQ ID NO: 284 - DNA, 33 bp, homo sapien
agattttcacatacaaygctttgataaactctt

SEQ ID NO: 285 - DNA, 33 bp, homo sapien
aatacagcacaaatcasccaaacaaattttaat

SEQ ID NO: 286 - DNA, 33 bp, homo sapien
tgcaccacttcattccrgcttgagtgacagagc

SEQ ID NO: 287 - DNA, 33 bp, homo sapien
atagaaagcatttgccygtacagcattgtggag

SEQ ID NO: 288 - DNA, 33 bp, homo sapien
gcagcgtctattcgtartttctgacactcagct

SEQ ID NO: 289 - DNA, 33 bp, homo sapien
aggcctgagatgagacmaaaatgtttactgtgg

SEQ ID NO: 290 - DNA, 33 bp, homo sapien
aaatagtaagtgctcaragatatttcctgtaat

SEQ ID NO: 291 - DNA, 33 bp, homo sapien
gctgcctggattctctsatacttagcaccaatt

SEQ ID NO: 292 - DNA, 33 bp, homo sapien
taacttccctgtatttsttggtttcagtattaa

SEQ ID NO: 293 - DNA, 33 bp, homo sapien
tgagtttgaaatcgggratacaatgataagtaa

SEQ ID NO: 294 - DNA, 33 bp, homo sapien
tacaaatgcatttaagsagatgtcaaggggatt

SEQ ID NO: 295 - DNA, 33 bp, homo sapien
ctcctgtctctcacacrtataattttttaaaac

SEQ ID NO: 296 - DNA, 33 bp, homo sapien
tatgtacatattatgcmcagttggatttatttg

SEQ ID NO: 297 - DNA, 33 bp, homo sapien
tctagaccctgaatacygaaaaggctctctccc

SEQ ID NO: 298 - DNA, 33 bp, homo sapien
gaggtttctacagagtracaaaacaaaacaata

SEQ ID NO: 299 - DNA, 33 bp, homo sapien
catctgacattccaggmaaagcaaactgcttta

SEQ ID NO: 300 - DNA, 33 bp, homo sapien
tgacagacttccaaaasatcccctgtgaggttg

SEQ ID NO: 301 - DNA, 33 bp, homo sapien
ttgtttcacatttcctyatagtttcaccaccca

SEQ ID NO: 302 - DNA, 33 bp, homo sapien
ttgcagtcagttgttgsgataagatctagattt

SEQ ID NO: 303 - DNA, 33 bp, homo sapien
tccttgtcctttatttyggcagatgttaccccc

SEQ ID NO: 304 - DNA, 33 bp, homo sapien
agccaagcttgaaatgrtgctgacaagggccag

SEQ ID NO: 305 - DNA, 33 bp, homo sapien
gagttgatgtcatggawgtagagagtagaatag

SEQ ID NO: 306 - DNA, 33 bp, homo sapien
gtcgctatgaattttcygtctttaattctataa

SEQ ID NO: 307 - DNA, 33 bp, homo sapien
atccaagtatagggccrttgaaaaacacacgta

SEQ ID NO: 308 - DNA, 33 bp, homo sapien
aagaaatgcaagatttrtgagtcatgaaaatgt

SEQ ID NO: 309 - DNA, 33 bp, homo sapien
cacagttatgcctgtcrttgaaccaggagtcaa

SEQ ID NO: 310 - DNA, 33 bp, homo sapien
ttccaacactgctttgkttcacataagtgattg

SEQ ID NO: 311 - DNA, 33 bp, homo sapien
aaagagcagcaggaaamtgaaacttggatggga

SEQ ID NO: 312 - DNA, 33 bp, homo sapien
ttaacaatggagtctgycagatcaacaattctc

SEQ ID NO: 313 - DNA, 33 bp, homo sapien
tatgcctaaaagtgcaygatttccatcagagaa

SEQ ID NO: 314 - DNA, 33 bp, homo sapien
ctaagatattctgtgayagtagcccaaatggac

SEQ ID NO: 315 - DNA, 33 bp, homo sapien
gagaataaactcagaaragaatcaaagataatc

SEQ ID NO: 316 - DNA, 33 bp, homo sapien
tgggctcttcttttacrtgtcatcttagaggaa

SEQ ID NO: 317 - DNA, 33 bp, homo sapien
ggtagcacctatatttygaaggtgacacattaa

SEQ ID NO: 318 - DNA, 33 bp, homo sapien
ttgatctggttcagaayatcacaaggtgtatgg

SEQ ID NO: 319 - DNA, 33 bp, homo sapien
ctatccccaaaattaaygcttagcttcagtaaa

SEQ ID NO: 320 - DNA, 33 bp, homo sapien
ctttactcaagttgatrtaggtttaagttatgt

SEQ ID NO: 321 - DNA, 33 bp, homo sapien
tcttctttactgcatcrttaattttttcctctc

SEQ ID NO: 322 - DNA, 33 bp, homo sapien
ctccattgcaagagccrtggaggactctggtgt

SEQ ID NO: 323 - DNA, 33 bp, homo sapien
ctggagcactgtagatycatcaaccttgcaatc

SEQ ID NO: 324 - DNA, 33 bp, homo sapien
gtgaataaaacagaagrtatggaggtgaagaca

SEQ ID NO: 325 - DNA, 33 bp, homo sapien
tattactagaagctacytttttcctaggagcta

SEQ ID NO: 326 - DNA, 33 bp, homo sapien
aaaagataaagccaagrcaatattaggatttca

SEQ ID NO: 327 - DNA, 33 bp, homo sapien
aaaggatgttatggaastcataatttttaaaag

SEQ ID NO: 328 - DNA, 33 bp, homo sapien
ggtgtctttgaaacaayagagataccagaagct

SEQ ID NO: 329 - DNA, 33 bp, homo sapien
caccataactggcactrtttctgagaaattcaa

SEQ ID NO: 330 - DNA, 33 bp, homo sapien
ttcatattccattctgyggataggccacatttt

SEQ ID NO: 331 - DNA, 33 bp, homo sapien
taaagttgtatttctgmtgttttaaaatgtcta

SEQ ID NO: 332 - DNA, 33 bp, homo sapien
aggaaacctgataggaytttagccttttacctg

SEQ ID NO: 333 - DNA, 33 bp, homo sapien
tgttgcttctgccttcyacttcccaggctggga

SEQ ID NO: 334 - DNA, 33 bp, homo sapien
agtcaggatctggccaygccaaattggaacctg

SEQ ID NO: 335 - DNA, 33 bp, homo sapien
atggatatgcgtttacrtcgaagggcttgattt

SEQ ID NO: 336 - DNA, 33 bp, homo sapien
gtcggattgtgttttgktgattgtatgtgtcaa

SEQ ID NO: 337 - DNA, 33 bp, homo sapien
ctaaagaacgaagaagrtggcaaagatttgtca

SEQ ID NO: 338 - DNA, 33 bp, homo sapien
tgggtaactaggggtcrtgtcttgaagctacat

SEQ ID NO: 339 - DNA, 33 bp, homo sapien
cacctggtttagtccaygaactccgaacactga

SEQ ID NO: 340 - DNA, 33 bp, homo sapien
ttggcaaagatggatckgagagtcaggggaaag

SEQ ID NO: 341 - DNA, 33 bp, homo sapien
gcttttgggcacaaatmccacatattacacttc

SEQ ID NO: 342 - DNA, 33 bp, homo sapien
tagattataaagccagmcctcatgaaaaggatt

SEQ ID NO: 343 - DNA, 33 bp, homo sapien
gggtggccaccatcatycatacagagagggcag

SEQ ID NO: 344 - DNA, 33 bp, homo sapien
tgtctacccctgatagrctgcaatataagacac

SEQ ID NO: 345 - DNA, 33 bp, homo sapien
attggaagagtccatckaatgctaagcaggata

SEQ ID NO: 346 - DNA, 33 bp, homo sapien
tcttgctttctccaatmtgaaaggtgtgagccc

SEQ ID NO: 347 - DNA, 33 bp, homo sapien
gaaaccaagaaagcacycaaaaactaatgggaa

SEQ ID NO: 348 - DNA, 33 bp, homo sapien
caaactctcttgggacmagaaatactaaacact

SEQ ID NO: 349 - DNA, 33 bp, homo sapien
ctgtatgatgtgctaartgttgccagatgaaaa

SEQ ID NO: 350 - DNA, 33 bp, homo sapien
acctttgctgttttaasctactgaggtcttggg

SEQ ID NO: 351 - DNA, 33 bp, homo sapien
aggtaatatagtaacargttctgggaattaaga

SEQ ID NO: 352 - DNA, 33 bp, homo sapien
tatgtgtctccacaccwcagctgtagcctaatg

SEQ ID NO: 353 - DNA, 33 bp, homo sapien
ggtaaatggttagaaakggaataaactggaaaa

SEQ ID NO: 354 - DNA, 33 bp, homo sapien
aggacaaatatgatacygacaggctattaataa

SEQ ID NO: 355 - DNA, 33 bp, homo sapien
tatgcagttgctgtgarctgccatctcttcttc

SEQ ID NO: 356 - DNA, 33 bp, homo sapien
cttggatttcaacatawaaccttgaagcaaact

SEQ ID NO: 357 - DNA, 33 bp, homo sapien
tatttcccaagttaagkcaaatttcaaaaagca

SEQ ID NO: 358 - DNA, 33 bp, homo sapien
gattataagccaaactrcaatatctgccacaat

SEQ ID NO: 359 - DNA, 33 bp, homo sapien
ctccactcataaacaarggaagctaggatgttt

SEQ ID NO: 360 - DNA, 33 bp, homo sapien
ctgctcctcttcctgcrttcaggtgtagtcctg

SEQ ID NO: 361 - DNA, 33 bp, homo sapien
agacatcattccaaacmgagactagcaggtgca

SEQ ID NO: 362 - DNA, 33 bp, homo sapien
ctctctggttaaaatgkgtagactcttcattca

SEQ ID NO: 363 - DNA, 33 bp, homo sapien
gtcatatgtttagtgtyggtaagatctatattg

SEQ ID NO: 364 - DNA, 33 bp, homo sapien
actgtagcacaatattkattgcacaatagctat

SEQ ID NO: 365 - DNA, 33 bp, homo sapien
ccatcacaacattcatstcctctgagtccaggt

SEQ ID NO: 366 - DNA, 33 bp, homo sapien
acagaattctaaaaaamgttcaagtaacctaca

SEQ ID NO: 367 - DNA, 33 bp, homo sapien
ttatgacttataaaacrtatagcaaacatgtgg

SEQ ID NO: 368 - DNA, 33 bp, homo sapien
tatttagaagagatgtyacatgttgcattgaga

SEQ ID NO: 369 - DNA, 33 bp, homo sapien
tttacttaacagaattktaatcatgcagaaatg

SEQ ID NO: 370 - DNA, 33 bp, homo sapien
gtattaagtactttttmgcagttaagtccactc

SEQ ID NO: 371 - DNA, 33 bp, homo sapien
cactttgggagactgcrgttggaggatgacttg

SEQ ID NO: 372 - DNA, 33 bp, homo sapien
gttcggcttatctaatrcgttgggtggtacaag

SEQ ID NO: 373 - DNA, 33 bp, homo sapien
catagcacagttgtacrtgattttgatcataga

SEQ ID NO: 374 - DNA, 33 bp, homo sapien
ggaaagagaggaggcayattgtactcactggta

SEQ ID NO: 375 - DNA, 33 bp, homo sapien
gatgaagaaaatgtcargattttaaatatggac

SEQ ID NO: 376 - DNA, 33 bp, homo sapien
ggaagtatcacgatttmtcttcctttttcaggc

SEQ ID NO: 377 - DNA, 33 bp, homo sapien
aagtcttgcagtattgyttaaccctgaaggagt

SEQ ID NO: 378 - DNA, 33 bp, homo sapien
aataacacatagaatakttttctcagaacttgt

SEQ ID NO: 379 - DNA, 33 bp, homo sapien
taagaagtttcaaaacrgggccactccagtcta

SEQ ID NO: 380 - DNA, 33 bp, homo sapien
tatattttatagcaacmataatagaatgatagc

SEQ ID NO: 381 - DNA, 33 bp, homo sapien
attctctgatcacaagrttttggaaaagcccca

SEQ ID NO: 382 - DNA, 33 bp, homo sapien
tctagacatacatacaraaggttaatgtcaaag

SEQ ID NO: 383 - DNA, 33 bp, homo sapien
tcagcacagttaattcyagggctgcctgcagat

SEQ ID NO: 384 - DNA, 33 bp, homo sapien
taagattgatcgaggawtatgttattattctgt

SEQ ID NO: 385 - DNA, 33 bp, homo sapien
gtgtcgccaaaaactaygtactcttggtggaaa

SEQ ID NO: 386 - DNA, 33 bp, homo sapien
tctctactgtattggayaaaactagaggggaaa

SEQ ID NO: 387 - DNA, 33 bp, homo sapien
atgcgttcctcatgcaytctgttgttagtgaaa

SEQ ID NO: 388 - DNA, 33 bp, homo sapien
acccttcctcttccacrgtccaacaagataaac

SEQ ID NO: 389 - DNA, 33 bp, homo sapien
gtacatttaaagagccrtgattattgtaaatac

SEQ ID NO: 390 - DNA, 33 bp, homo sapien
catggaaagcagtaatkgaaataaagatcccag

SEQ ID NO: 391 - DNA, 33 bp, homo sapien
attgcaagagaataggyctgagtcttgctgtag

SEQ ID NO: 392 - DNA, 33 bp, homo sapien
gggacattgaaggagtrtgattaccacctgcct

SEQ ID NO: 393 - DNA, 33 bp, homo sapien
gttaaatgcaacaaacrttcacatagaatatgg

SEQ ID NO: 394 - DNA, 33 bp, homo sapien
ccatttacatcattttyttcctagtaactagaa

SEQ ID NO: 395 - DNA, 33 bp, homo sapien
ggtaggttttcccagcsatttccttggtctgag

SEQ ID NO: 396 - DNA, 33 bp, homo sapien
gcttgcatctttgttgrtctaccaatctccatc

SEQ ID NO: 397 - DNA, 33 bp, homo sapien
attagtgctttttaaastttggaaaatataaat

SEQ ID NO: 398 - DNA, 33 bp, homo sapien
ttctggtgcttttctcygcaggcctcatttgca

SEQ ID NO: 399 - DNA, 33 bp, homo sapien
aaattctacaactagasctggttggatcagtat

SEQ ID NO: 400 - DNA, 33 bp, homo sapien
gctcccgcagcttttcytgcagtaaagactgct

SEQ ID NO: 401 - DNA, 33 bp, homo sapien
ctgtcccttggtgacarcatcactatttatatg

SEQ ID NO: 402 - DNA, 33 bp, homo sapien
ttccaggcttgtagaaktagcttccagctctaa

SEQ ID NO: 403 - DNA, 33 bp, homo sapien
actttttggcatcatayaataagtgacaaaact

SEQ ID NO: 404 - DNA, 33 bp, homo sapien
ctgggtgcctcaacagyccttgtttattcctat

SEQ ID NO: 405 - DNA, 33 bp, homo sapien
cagttaactgagagatyattaagcatcactctt

SEQ ID NO: 406 - DNA, 33 bp, homo sapien
aaacaatatttgaactracataaagaataagaa

SEQ ID NO: 407 - DNA, 33 bp, homo sapien
ttgtgtggctgctgcartattaagttccttgtg

SEQ ID NO: 408 - DNA, 33 bp, homo sapien
taagcagatgtttaaamaagtgaccttcctcac

SEQ ID NO: 409 - DNA, 33 bp, homo sapien
ttctttttagatcaggytggttaggcagataag

SEQ ID NO: 410 - DNA, 33 bp, homo sapien
aattatgcttactatgytcatgcagctaaaagc

SEQ ID NO: 411 - DNA, 33 bp, homo sapien
aaataccagaaagtgcraaggaaaaagtaagaa

SEQ ID NO: 412 - DNA, 33 bp, homo sapien
tggaaggtgcttaatcygtttgggctactacaa

SEQ ID NO: 413 - DNA, 33 bp, homo sapien
tcatatctgtttaggtkcaactttgcttttctt

SEQ ID NO: 414 - DNA, 33 bp, homo sapien
tgaccagttaagccagwggacgacccacccagg

SEQ ID NO: 415 - DNA, 33 bp, homo sapien
gttcattaaccaaaagrgttgttgtttgccagt

SEQ ID NO: 416 - DNA, 33 bp, homo sapien
tatatgtatagctttgycaccagtatctaaata

SEQ ID NO: 417 - DNA, 33 bp, homo sapien
accatcgcctgtcaccrtgttctttggctgctt

SEQ ID NO: 418 - DNA, 33 bp, homo sapien
ctttcttgtaggatccygcaaagaacaactgaa

SEQ ID NO: 419 - DNA, 33 bp, homo sapien
gaccatctattacttcrattcaactctcataca

SEQ ID NO: 420 - DNA, 33 bp, homo sapien
caattgttatctgaggwtgaaaaaatgaccccc

SEQ ID NO: 421 - DNA, 33 bp, homo sapien
gtatatgttttattcaygttctcggtggcgtat

SEQ ID NO: 422 - DNA, 33 bp, homo sapien
tacagatgtgtgactcrtttgcatatcggagac

SEQ ID NO: 423 - DNA, 33 bp, homo sapien
accaggaggatccaacrggaaggcaactttttt

SEQ ID NO: 424 - DNA, 33 bp, homo sapien
ttcaatatgcactttcsttaataaaaatgtaca

SEQ ID NO: 425 - DNA, 33 bp, homo sapien
atctttcttgaagtagycatactataccctagg

SEQ ID NO: 426 - DNA, 33 bp, homo sapien
aaatagatgatagcatstcatctgcagccccag

SEQ ID NO: 427 - DNA, 33 bp, homo sapien
ttggctttccttccagstgatgaaattccagaa

SEQ ID NO: 428 - DNA, 33 bp, homo sapien
caccgaatgttgacaasgatgctgaacaatagg

SEQ ID NO: 429 - DNA, 33 bp, homo sapien
tttcccgctaccttctrttttggtctaattaat

SEQ ID NO: 430 - DNA, 33 bp, homo sapien
ctgctttatcaatgaaktttatgtaatattcta

SEQ ID NO: 431 - DNA, 33 bp, homo sapien
ttctcaagaagattaarctgatcggccaataaa

SEQ ID NO: 432 - DNA, 33 bp, homo sapien
caacgattgttcgagayttacatgctcatgact

SEQ ID NO: 433 - DNA, 33 bp, homo sapien
tgcaaaaacagccaatrtaacattcagtggtga

SEQ ID NO: 434 - DNA, 33 bp, homo sapien
tcttcctttctgatctkatcttgtgctgctcct

SEQ ID NO: 435 - DNA, 33 bp, homo sapien
agatctgaagagaacaytggaaaagaggcccac

SEQ ID NO: 436 - DNA, 33 bp, homo sapien
ataacaataccctttcrgaggagactgtaaaac

SEQ ID NO: 437 - DNA, 33 bp, homo sapien
ggggcagatcccttacraatggcttggtgctgt

SEQ ID NO: 438 - DNA, 33 bp, homo sapien
caaagaaataccattgyttgcatgtcaaattgg

SEQ ID NO: 439 - DNA, 33 bp, homo sapien
gtagacatttacgtagwcgtttttgtgtgaaca

SEQ ID NO: 440 - DNA, 33 bp, homo sapien
catctgaccgcttgttyactttatgtgtcaact

SEQ ID NO: 441 - DNA, 33 bp, homo sapien
tcaaaggctgaaagtargagtggcctcagtaat

SEQ ID NO: 442 - DNA, 33 bp, homo sapien
tctcagcgctagttgayggctagcccaagctgc

SEQ ID NO: 443 - DNA, 33 bp, homo sapien
catctagataactctgyaattaagtggagcatc

SEQ ID NO: 444 - DNA, 33 bp, homo sapien
aaaataggaaaatgtcmtattgaatcaagctgt

SEQ ID NO: 445 - DNA, 33 bp, homo sapien
tcctgcatttggctgtyagtgaagcggaagcag

SEQ ID NO: 446 - DNA, 33 bp, homo sapien
tatgattttaggctatkcatttaaatctctctg

SEQ ID NO: 447 - DNA, 33 bp, homo sapien
acctggaatgtcaaagrtaaagtgcaacacatt

SEQ ID NO: 448 - DNA, 33 bp, homo sapien
acacataacccgcttgwatctgcactaccacct

SEQ ID NO: 449 - DNA, 33 bp, homo sapien
gggtgaggcatcctacwagcattgtgacgcatg

SEQ ID NO: 450 - DNA, 33 bp, homo sapien
atctaagaaggacctawgagctccctaatcaat

SEQ ID NO: 451 - DNA, 33 bp, homo sapien
ttcctcactactctcaraaatcagaaagttcct

SEQ ID NO: 452 - DNA, 33 bp, homo sapien
tataacaggttttggtmgtttgttcctttcatt

SEQ ID NO: 453 - DNA, 33 bp, homo sapien
aatgatttgagtctaaraacaaggcagtgtgaa

SEQ ID NO: 454 - DNA, 33 bp, homo sapien
catatagtggctaatayatgaggtgcattgaga

SEQ ID NO: 455 - DNA, 33 bp, homo sapien
tagattatatgctaatkgctctccactcccatg

SEQ ID NO: 456 - DNA, 33 bp, homo sapien
cactggaaagcatccgrcttcttaaaggtagac

SEQ ID NO: 457 - DNA, 33 bp, homo sapien
aacctactagagcagaraagaatggtcaaagga

SEQ ID NO: 458 - DNA, 33 bp, homo sapien
atttatttgcttgcttrggattttcatattgat

SEQ ID NO: 459 - DNA, 33 bp, homo sapien
aatgttttattataagycataggtacagaactt

SEQ ID NO: 460 - DNA, 33 bp, homo sapien
gattattctcaccacarcaatttttcccttcga

SEQ ID NO: 461 - DNA, 33 bp, homo sapien
aagcaacctgtgtggcratatgattagttacaa

SEQ ID NO: 462 - DNA, 33 bp, homo sapien
gagcatggttaactaaytacatgctaagagttc

SEQ ID NO: 463 - DNA, 33 bp, homo sapien
aaaaagcagtttgaccrtaatgtgccctggtat

SEQ ID NO: 464 - DNA, 33 bp, homo sapien
caattctttttacatasttggttgcttcccttg

SEQ ID NO: 465 - DNA, 33 bp, homo sapien
tcctgggtgatcctgawggtcatggatgtttgt

SEQ ID NO: 466 - DNA, 33 bp, homo sapien
gaatatgatgccattakataactttagatgctt

SEQ ID NO: 467 - DNA, 33 bp, homo sapien
aggaaagaaaccaagaycctggagatacaaacc

SEQ ID NO: 468 - DNA, 33 bp, homo sapien
gggcgagggccacaagrtcagataagtgagttt

SEQ ID NO: 469 - DNA, 33 bp, homo sapien
catgcctcaagccaatraaagcccgaaaggtat

SEQ ID NO: 470 - DNA, 33 bp, homo sapien
tttcacgaagagagccytgaaaaatctcatctc

SEQ ID NO: 471 - DNA, 33 bp, homo sapien
gagagtggtgttcagtytcacccattagagctc

SEQ ID NO: 472 - DNA, 33 bp, homo sapien
gtttttcctctttgctstgttatttatttatct

SEQ ID NO: 473 - DNA, 33 bp, homo sapien
accaatagctcaagaartgctgttataataacc

SEQ ID NO: 474 - DNA, 33 bp, homo sapien
atggaatgagcaaattktggtatattcatgcag

SEQ ID NO: 475 - DNA, 33 bp, homo sapien
aacaatgttctaaattygtcgtgcgatggggaa

SEQ ID NO: 476 - DNA, 33 bp, homo sapien
atcttccaactgacctmctgatttccatcccaa

SEQ ID NO: 477 - DNA, 33 bp, homo sapien
gtatggactttattttytttatcccgcatggga

SEQ ID NO: 478 - DNA, 33 bp, homo sapien
gttttgttcatgctgcrattttctttattcctt

SEQ ID NO: 479 - DNA, 33 bp, homo sapien
aaattcagcccagatgyggagtcacagagtatt

SEQ ID NO: 480 - DNA, 33 bp, homo sapien
ggtagataagcctgtgytttccttaaacaagtc

SEQ ID NO: 481 - DNA, 33 bp, homo sapien
gaaagtgaaaaacacartggttgcatgagtact

SEQ ID NO: 482 - DNA, 33 bp, homo sapien
tcaaggtggattgtttmcctgtctgttttgtaa

SEQ ID NO: 483 - DNA, 33 bp, homo sapien
tggcaacatggttaagsatcagcattccagcac

SEQ ID NO: 484 - DNA, 33 bp, homo sapien
agactgtgagtagttayagcagtgaaacaggat

SEQ ID NO: 485 - DNA, 33 bp, homo sapien
agtcaggggaaaaaatragcttcagagtgagat

SEQ ID NO: 486 - DNA, 33 bp, homo sapien
gcagctatcacctttgwtgagtggccatcttcc

SEQ ID NO: 487 - DNA, 33 bp, homo sapien
cagtcttcatccataakgcatgaggccggagac

SEQ ID NO: 488 - DNA, 33 bp, homo sapien
gtttccccgaggcatcrgttactatcaccaaca

SEQ ID NO: 489 - DNA, 33 bp, homo sapien
caacaccacagttgatrgtagtacatagtctga

SEQ ID NO: 490 - DNA, 33 bp, homo sapien
aacttcagacataaacracataagcacagggtc

SEQ ID NO: 491 - DNA, 33 bp, homo sapien
ggtttcccatgacccaratttaccatcctccct

SEQ ID NO: 492 - DNA, 33 bp, homo sapien
aaaggaatttggaatcragatagtttgggattg

SEQ ID NO: 493 - DNA, 33 bp, homo sapien
cctgtcaataggagcgwctcacgcgctgggtct

SEQ ID NO: 494 - DNA, 33 bp, homo sapien
atcagcatactcttttygttcagccttcaaagt

SEQ ID NO: 495 - DNA, 33 bp, homo sapien
agaggatactgatacayttttttgcagatgtaa

SEQ ID NO: 496 - DNA, 33 bp, homo sapien
ttatagaaggtagggcrctacagaacaagtcag

SEQ ID NO: 497 - DNA, 33 bp, homo sapien
aaagatatttacagagrccaacagcaaaataaa

SEQ ID NO: 498 - DNA, 33 bp, homo sapien
catgaaccaaagagatkcaggttaatttcctac

SEQ ID NO: 499 - DNA, 33 bp, homo sapien
taatttggaaactttarttgatgtaattaacgc

SEQ ID NO: 500 - DNA, 33 bp, homo sapien
gatgaagtaagcttggmcagctgagttctaaag

SEQ ID NO: 501 - DNA, 33 bp, homo sapien
tccttcctccttgactytggatttaaagctttt

SEQ ID NO: 502 - DNA, 33 bp, homo sapien
agttagaaatgcctgaygaaggagttcctctat

SEQ ID NO: 503 - DNA, 33 bp, homo sapien
aaacatttatcactcargactattgtgtcaaaa

SEQ ID NO: 504 - DNA, 33 bp, homo sapien
aatctgttctcagtttkggagagaatatgattt

SEQ ID NO: 505 - DNA, 33 bp, homo sapien
taacaattcagttagamcagagtgctgagagca

SEQ ID NO: 506 - DNA, 33 bp, homo sapien
gagtatgctgtgcagcrgttatccctttatgtg

SEQ ID NO: 507 - DNA, 33 bp, homo sapien
tgggctcaaaagtcaakccagtgcctgtgaaaa

SEQ ID NO: 508 - DNA, 33 bp, homo sapien
taactgagaaagttcayataactgcaaagcatc

SEQ ID NO: 509 - DNA, 33 bp, homo sapien
gggatgacgtttgctcrgtcttatttcatgcct

SEQ ID NO: 510 - DNA, 33 bp, homo sapien
gactagagatagggctrtagtaaggagtaaaac

SEQ ID NO: 511 - DNA, 33 bp, homo sapien
agctgtgtttgtgagartcctcttttacattct

SEQ ID NO: 512 - DNA, 33 bp, homo sapien
aacaatcttaccagaakttatgtaccaaatcaa

SEQ ID NO: 513 - DNA, 33 bp, homo sapien
tgtgttagtttcaaaartcttaatgtagattat

SEQ ID NO: 514 - DNA, 33 bp, homo sapien
aaataacattaattttrtctgcagcatcctttg

SEQ ID NO: 515 - DNA, 33 bp, homo sapien
accatctatttcagatktggaatcgcgacattt

SEQ ID NO: 516 - DNA, 33 bp, homo sapien
gctacaatgtttcaatygctaaaaccaagtaca

SEQ ID NO: 517 - DNA, 33 bp, homo sapien
gcatccacttggagaaygtttttttgtgtgtgg

SEQ ID NO: 518 - DNA, 33 bp, homo sapien
gctagcatattgtcatratcacttcattttatt

SEQ ID NO: 519 - DNA, 33 bp, homo sapien
cctggcttgactttaaytgggctttttctcctc

SEQ ID NO: 520 - DNA, 33 bp, homo sapien
gtgggtgggagggtatyttgcatttgtcttggt

SEQ ID NO: 521 - DNA, 33 bp, homo sapien
actcaaccatgctacaratgtttattgagaaca

SEQ ID NO: 522 - DNA, 33 bp, homo sapien
atagcactgattcctarcagggttattttcatt

SEQ ID NO: 523 - DNA, 33 bp, homo sapien
tcaaagcttcccatgtkatttgagtgtgcatgc

SEQ ID NO: 524 - DNA, 33 bp, homo sapien
aagattagctgtagccrcacattccagaaggag

SEQ ID NO: 525 - DNA, 33 bp, homo sapien
agtaaagtatatttagytcatttccaaatgacc

SEQ ID NO: 526 - DNA, 33 bp, homo sapien
gactgccagtgctaatygtgtcattacagaaat

SEQ ID NO: 527 - DNA, 33 bp, homo sapien
gaaacattgtcactccragggctgaggtggtaa

SEQ ID NO: 528 - DNA, 33 bp, homo sapien
aaatttggagaatgcaraaaaatcaaaatggca

SEQ ID NO: 529 - DNA, 33 bp, homo sapien
gatcctgttgatgagastgatggcaaatgcacc

SEQ ID NO: 530 - DNA, 33 bp, homo sapien
aaaaatccaacggactstccagacaactctcaa

SEQ ID NO: 531 - DNA, 33 bp, homo sapien
aatagaaaggtccagcrgacagttgtgcaaaca

SEQ ID NO: 532 - DNA, 33 bp, homo sapien
tcctaaagtgcccattraactgtagtgggctct

SEQ ID NO: 533 - DNA, 33 bp, homo sapien
atttgctattattttayggtatctgcaggtttt

SEQ ID NO: 534 - DNA, 33 bp, homo sapien
tggagatgctttaaagkaatttatggaatttat

SEQ ID NO: 535 - DNA, 33 bp, homo sapien
gagctgcatagcaacaygatttctgaaaatgaa

SEQ ID NO: 536 - DNA, 33 bp, homo sapien
gtaaataactccagagygtagcatcaaagcaaa

SEQ ID NO: 537 - DNA, 33 bp, homo sapien
taaatgtgaacatcatyaaacagattttttttc

SEQ ID NO: 538 - DNA, 33 bp, homo sapien
gtaaaacagtagagtgycaagcacagaagtgcc

SEQ ID NO: 539 - DNA, 33 bp, homo sapien
cattcaggaaaaatatrgccctgaggattgaca

SEQ ID NO: 540 - DNA, 33 bp, homo sapien
ctggtgtgtgagtctgrgaaagtcagttccttt

SEQ ID NO: 541 - DNA, 33 bp, homo sapien
taacaacactaaatgtyggtgaagatgttgagt

SEQ ID NO: 542 - DNA, 33 bp, homo sapien
agatacacagtattctyggtagtcctgtagagt

SEQ ID NO: 543 - DNA, 33 bp, homo sapien
cctgggacatctgctcrctttgggactctttgt

SEQ ID NO: 544 - DNA, 33 bp, homo sapien
ggtttggatatgcctcrcagttgcattggacct

SEQ ID NO: 545 - DNA, 33 bp, homo sapien
cttccatctagtttgargtacggcatcattaca

SEQ ID NO: 546 - DNA, 33 bp, homo sapien
ttttagcctcaacatcytcatctgcaaactagg

SEQ ID NO: 547 - DNA, 33 bp, homo sapien
cagaaagcccaaagctstatgatgaccctgttg

SEQ ID NO: 548 - DNA, 33 bp, homo sapien
tactacattgattgaarggctattccattcata

SEQ ID NO: 549 - DNA, 33 bp, homo sapien
ctctgtgcagtcctctstcattgtccttgaagc

SEQ ID NO: 550 - DNA, 33 bp, homo sapien
atggagcgcatttcatmtaacactaattttcct

SEQ ID NO: 551 - DNA, 33 bp, homo sapien
tctgtcattatatctgkctacattttatccatc

SEQ ID NO: 552 - DNA, 33 bp, homo sapien
tagaaattgggatcatyaaaggagagaaaaaaa

SEQ ID NO: 553 - DNA, 33 bp, homo sapien
ctgttgatcacgtggtytgccagggctgctctt

SEQ ID NO: 554 - DNA, 33 bp, homo sapien
tttgatgcatcattaartagagacataagatca

SEQ ID NO: 555 - DNA, 33 bp, homo sapien
aaaatgaaaatgaatcragccctttattctcac

SEQ ID NO: 556 - DNA, 33 bp, homo sapien
tttaggaaaacatgatytgatcctagaaatcat

SEQ ID NO: 557 - DNA, 33 bp, homo sapien
gactgaatggaaaaaayaaactttgttagtgac

SEQ ID NO: 558 - DNA, 33 bp, homo sapien
taggtgcataaaaagarcattcataataaggct

SEQ ID NO: 559 - DNA, 33 bp, homo sapien
ctgttttcttgtcctgygacagtgttcagggtg

SEQ ID NO: 560 - DNA, 33 bp, homo sapien
ttggcagacttcctgtygatgggccaaacggtg

SEQ ID NO: 561 - DNA, 33 bp, homo sapien
aatcccagtgcctaacygggtgccttcagtgtt

SEQ ID NO: 562 - DNA, 33 bp, homo sapien
ttatgtcagtggctgargtgtggttttaatcta

SEQ ID NO: 563 - DNA, 33 bp, homo sapien
tccaaagtctaaaaaamccctgaaatctgaaac

SEQ ID NO: 564 - DNA, 33 bp, homo sapien
aatcagtgttgaactcrgtatgtttaatttcag

SEQ ID NO: 565 - DNA, 33 bp, homo sapien
aaataatgtcttcatcrgtttatttcttctgag

SEQ ID NO: 566 - DNA, 33 bp, homo sapien
attgtttctggctctgycgtttctactatattt

SEQ ID NO: 567 - DNA, 33 bp, homo sapien
ctttggatgcagatgasagagtgtgtctaatta

SEQ ID NO: 568 - DNA, 33 bp, homo sapien
gaaagacacttcatacrgagagtttggatgctt

SEQ ID NO: 569 - DNA, 33 bp, homo sapien
ggtttataaaaggtcamaaagctaaatacagga

SEQ ID NO: 570 - DNA, 33 bp, homo sapien
aagaggcaatctgcatrgcatcagaacagaaaa

SEQ ID NO: 571 - DNA, 33 bp, homo sapien
tgtttggagcccatagkaggaagttcccacaag

SEQ ID NO: 572 - DNA, 33 bp, homo sapien
ttatatcatctgtgttyctacatatagacgtat

SEQ ID NO: 573 - DNA, 33 bp, homo sapien
gtgttttgaacagcagytgtggaactcagagac

SEQ ID NO: 574 - DNA, 33 bp, homo sapien
agtgaagtggaccttgrtgtgactcctggttct

SEQ ID NO: 575 - DNA, 33 bp, homo sapien
cataaaacctagagaaygtctttgcataaataa

SEQ ID NO: 576 - DNA, 33 bp, homo sapien
taaaaatagaaggaaawgtcagggaaatgtcat

SEQ ID NO: 577 - DNA, 33 bp, homo sapien
agtcacccacctcaccrtgttagagaaaagaaa

SEQ ID NO: 578 - DNA, 33 bp, homo sapien
tttgaacctatcttgastagagctttgcacata

SEQ ID NO: 579 - DNA, 33 bp, homo sapien
tcctctcactcttagaytcaggaaattattgtc

SEQ ID NO: 580 - DNA, 33 bp, homo sapien
gtattgaacacaattgratcttattctgccata

SEQ ID NO: 581 - DNA, 33 bp, homo sapien
tgaataaggcattgttytacctttcagtgctca

SEQ ID NO: 582 - DNA, 33 bp, homo sapien
catgtggtctccatacmtcatcttcactggggg

SEQ ID NO: 583 - DNA, 33 bp, homo sapien
gatggcacgttaaagaragaaagatggcttggt

SEQ ID NO: 584 - DNA, 33 bp, homo sapien
tacgtgaggtaggcctytttgtgtaataattga

SEQ ID NO: 585 - DNA, 33 bp, homo sapien
ccagcgcattctattgkcaaggctgcgaggaat

SEQ ID NO: 586 - DNA, 33 bp, homo sapien
atgccttcctgagcgaktactgggtagcctgat

SEQ ID NO: 587 - DNA, 33 bp, homo sapien
aaagtgctgtgattgaytggtcatgtctgacgt

SEQ ID NO: 588 - DNA, 33 bp, homo sapien
tgcaagactgggagctytttggaaacagattat

SEQ ID NO: 589 - DNA, 33 bp, homo sapien
tgttatgaatgtatgcwactcttgtccttcagt

SEQ ID NO: 590 - DNA, 33 bp, homo sapien
ttttatatcccaggaakttgaaagtaatgattg

SEQ ID NO: 591 - DNA, 33 bp, homo sapien
tttaagcttaagaaagygatctcaggaagcaca

SEQ ID NO: 592 - DNA, 33 bp, homo sapien
aatagttacagccattkgagcaaatgaaaagat

SEQ ID NO: 593 - DNA, 33 bp, homo sapien
ctgtatgcaattccaasggctcagagcaaaaca

SEQ ID NO: 594 - DNA, 33 bp, homo sapien
agttgtttttcacgtgycactgtttccaaatat

SEQ ID NO: 595 - DNA, 33 bp, homo sapien
tggatgctgtagtggayatacctggtttttctg

SEQ ID NO: 596 - DNA, 33 bp, homo sapien
taggatgtcttggccarccacagcaacaataac

SEQ ID NO: 597 - DNA, 33 bp, homo sapien
gagtgatgaactcctgmggcagaagtattacca

SEQ ID NO: 598 - DNA, 33 bp, homo sapien
gaaaatgttctaaaatkgattaccaggatgatt

SEQ ID NO: 599 - DNA, 33 bp, homo sapien
gtcttccagactgtgaygaactgggcaaattaa

SEQ ID NO: 600 - DNA, 33 bp, homo sapien
acacccttcagcctggsatgagttaagttcagt

SEQ ID NO: 601 - DNA, 33 bp, homo sapien
ggggaaacatcagaatwatcataaatggagata

SEQ ID NO: 602 - DNA, 33 bp, homo sapien
ctgcaacttggagcctygtgagtgctggctggt

SEQ ID NO: 603 - DNA, 33 bp, homo sapien
taaataattcaaagcayggatttcaagcaagct

SEQ ID NO: 604 - DNA, 33 bp, homo sapien
tttgtatattatgagarttagtggtcactgttg

SEQ ID NO: 605 - DNA, 33 bp, homo sapien
aaactgccattgcaaartttactactgagacag

SEQ ID NO: 606 - DNA, 33 bp, homo sapien
tttctcatccacatttrcccagggcttagcctg

SEQ ID NO: 607 - DNA, 33 bp, homo sapien
aataacatctactcaaycttctaatcatttcaa

SEQ ID NO: 608 - DNA, 33 bp, homo sapien
tagctccttccagtgaraagtgtagacatttac

SEQ ID NO: 609 - DNA, 33 bp, homo sapien
gtagcgttaatgcttgrtgtatccgaaccagac

SEQ ID NO: 610 - DNA, 33 bp, homo sapien
atgaatgatatgaacarttaacatttcttggac

SEQ ID NO: 611 - DNA, 33 bp, homo sapien
tacataacaaaatcaaracgttgaaatttagcg

SEQ ID NO: 612 - DNA, 33 bp, homo sapien
ggagatcctgatgacaygtgcacaaggtggtcg

SEQ ID NO: 613 - DNA, 33 bp, homo sapien
ctagcaatgtgactccragctagttccctcatc

SEQ ID NO: 614 - DNA, 33 bp, homo sapien
ccgttctgccttcttcstttgttggcagcattc

SEQ ID NO: 615 - DNA, 33 bp, homo sapien
tgaaggcacagaggcaygctgatcaggaatgac

SEQ ID NO: 616 - DNA, 33 bp, homo sapien
caggtgcagactcctgrgtaaatattatctgtt

SEQ ID NO: 617 - DNA, 33 bp, homo sapien
tttaagttcaaggttawtttgatatgtgaagtt

SEQ ID NO: 618 - DNA, 33 bp, homo sapien
acaaagtgagtacaaamtagtctctgaaactaa

SEQ ID NO: 619 - DNA, 33 bp, homo sapien
ggtagggaagtgccttraagttggactagagta

SEQ ID NO: 620 - DNA, 33 bp, homo sapien
gcatccaggtgagtgayactgtccagcacacct

SEQ ID NO: 621 - DNA, 33 bp, homo sapien
tgtagagatattctaamacagactgaatgattg

SEQ ID NO: 622 - DNA, 33 bp, homo sapien
ccggagaccagtacagkagtgaacagatgagta

SEQ ID NO: 623 - DNA, 33 bp, homo sapien
atttgctcttggattcrccaagcactcatccta

SEQ ID NO: 624 - DNA, 33 bp, homo sapien
gaaagacaggatgacaragaaaagggcgcaatg

SEQ ID NO: 625 - DNA, 33 bp, homo sapien
tctcttgagtgcctttraagatttccggcttct

SEQ ID NO: 626 - DNA, 33 bp, homo sapien
ttgttggcatttacctrcttcaaaacatggaaa

SEQ ID NO: 627 - DNA, 33 bp, homo sapien
tctttatgcatgaaaayaccttcacaaagaaaa

SEQ ID NO: 628 - DNA, 33 bp, homo sapien
ctgagtctgattctcayaaatggcctagcatac

SEQ ID NO: 629 - DNA, 33 bp, homo sapien
tgtatagctgagggaaytgaggtccagggaagt

SEQ ID NO: 630 - DNA, 33 bp, homo sapien
attacctttttatgagragagataatagggagc

SEQ ID NO: 631 - DNA, 33 bp, homo sapien
actggttttgctattasggtaatgctagcttca

SEQ ID NO: 632 - DNA, 33 bp, homo sapien
acataatactttcaggyccaacaatactggcag

SEQ ID NO: 633 - DNA, 33 bp, homo sapien
tgctggttcccgaagcygatgggctctgtctta

SEQ ID NO: 634 - DNA, 33 bp, homo sapien
tcatgtcaagaaatgayaattgactttgaaatc

SEQ ID NO: 635 - DNA, 33 bp, homo sapien
agttctctcagttggayatgaatgttgctcttg

SEQ ID NO: 636 - DNA, 33 bp, homo sapien
tgaccttttaatggatrgattacacagagcaaa

SEQ ID NO: 637 - DNA, 33 bp, homo sapien
tcaaaaaacaggaaacwatgtcatattcagcac

SEQ ID NO: 638 - DNA, 33 bp, homo sapien
gggaaggccatgaatarcctcttgcctgtatgt

SEQ ID NO: 639 - DNA, 33 bp, homo sapien
tctgctgtctgatgttycttgcagccctcaagc

SEQ ID NO: 640 - DNA, 33 bp, homo sapien
cataaggagcttcctcyttcactgggcactcaa

SEQ ID NO: 641 - DNA, 33 bp, homo sapien
acattttcggtttggcrtagcacattgtgccaa

SEQ ID NO: 642 - DNA, 33 bp, homo sapien
ggttaatgggactcagyaattagtgaaacatac

SEQ ID NO: 643 - DNA, 33 bp, homo sapien
aagtagatttgtagaarggttgttggttggttt

SEQ ID NO: 644 - DNA, 33 bp, homo sapien
cggctaaaggagacacrggtgatccagcacctc

SEQ ID NO: 645 - DNA, 33 bp, homo sapien
catttcctggtgatcayattcccaactgttcca

SEQ ID NO: 646 - DNA, 33 bp, homo sapien
tgtaacagacactgagkattgttccctgtgcac

SEQ ID NO: 647 - DNA, 33 bp, homo sapien
aacatttcttccctggrtttcaatttggtaggc

SEQ ID NO: 648 - DNA, 33 bp, homo sapien
tgtgtgtgaaatgaccsaaaagataagagggta

SEQ ID NO: 649 - DNA, 33 bp, homo sapien
atggcatggaatgcttyaggatggccaagattg

SEQ ID NO: 650 - DNA, 33 bp, homo sapien
ggccagaatggtcctgyacaagttggatttgaa

SEQ ID NO: 651 - DNA, 33 bp, homo sapien
attaccaaagtggctartaattgagaatccaag

SEQ ID NO: 652 - DNA, 33 bp, homo sapien
atcttctttattcactrcaggttgttcttggtc

SEQ ID NO: 653 - DNA, 33 bp, homo sapien
ttttgtcactgtagaastctaacatgggatcca

SEQ ID NO: 654 - DNA, 33 bp, homo sapien
cctctcccgcaacattyacatctgcatcctcaa

SEQ ID NO: 655 - DNA, 33 bp, homo sapien
caggtacaaacaagccyggacagtgaagactat

SEQ ID NO: 656 - DNA, 33 bp, homo sapien
agcttttataatccttyctcaactagttctgga

SEQ ID NO: 657 - DNA, 33 bp, homo sapien
catctcctttctgcacrtgtctgagttgtgcgt

SEQ ID NO: 658 - DNA, 33 bp, homo sapien
gtcaaaaaatttcatgytaagccagccaggttt

SEQ ID NO: 659 - DNA, 33 bp, homo sapien
cctaaattacacaatcrtcagataaaaattgtg

SEQ ID NO: 660 - DNA, 33 bp, homo sapien
gctgcaggtccagcagytatcttgggccataag

SEQ ID NO: 661 - DNA, 33 bp, homo sapien
tctcagtagtggtgctkagaggttcctcaggca

SEQ ID NO: 662 - DNA, 33 bp, homo sapien
caagacagcagccaacrgtaattttttaaaaat

SEQ ID NO: 663 - DNA, 33 bp, homo sapien
tttctcctcattggcasaatatgcagggctcag

SEQ ID NO: 664 - DNA, 33 bp, homo sapien
ttctcccctagtcaaakagcctgtggacctccc

SEQ ID NO: 665 - DNA, 33 bp, homo sapien
ggtacaggcatttcttyttcaagtaatcaaaag

SEQ ID NO: 666 - DNA, 33 bp, homo sapien
tccttaaaaaattgtgraatttgggcaagtctt

SEQ ID NO: 667 - DNA, 33 bp, homo sapien
tgtggcaccccgagtcytgccattactactcat

SEQ ID NO: 668 - DNA, 33 bp, homo sapien
ttgactgaaaagctgcrggaccttgaattaaca

SEQ ID NO: 669 - DNA, 33 bp, homo sapien
agtagaaatttcagaargagaaccacacttata

SEQ ID NO: 670 - DNA, 33 bp, homo sapien
ctctagaacctcactgygaataaggaagatcaa

SEQ ID NO: 671 - DNA, 33 bp, homo sapien
ctaaagctatggtcacrcctggcacaaccgcca

SEQ ID NO: 672 - DNA, 33 bp, homo sapien
gatcattgtagtgcccwttggaggttggcatga

SEQ ID NO: 673 - DNA, 33 bp, homo sapien
tattcgtcattgtcctrtgatgatacttcacaa

SEQ ID NO: 674 - DNA, 33 bp, homo sapien
aactggagtcacaattytgctaacagtactaca

SEQ ID NO: 675 - DNA, 33 bp, homo sapien
atatttgctgagtaacwcctgcattctctcacc

SEQ ID NO: 676 - DNA, 33 bp, homo sapien
ctggttatggcttttgrcaacatcagccagagg

SEQ ID NO: 677 - DNA, 33 bp, homo sapien
tggttaaatatggatckttaatacctcaatagt

SEQ ID NO: 678 - DNA, 33 bp, homo sapien
agaaattgtggagctgrgtaataccctcattac

SEQ ID NO: 679 - DNA, 33 bp, homo sapien
agagctactggcatccrataggtagaggccagg

SEQ ID NO: 680 - DNA, 33 bp, homo sapien
atgtttgtctggtgatsattatttgcctgatga

SEQ ID NO: 681 - DNA, 33 bp, homo sapien
cagcaccacttcccaayaggatcagacctgggg

SEQ ID NO: 682 - DNA, 33 bp, homo sapien
caatgaccgccgatgcyggtcttccaaagagag

SEQ ID NO: 683 - DNA, 33 bp, homo sapien
cactgtgagaaagtcakgcttcagctcagatct

SEQ ID NO: 684 - DNA, 33 bp, homo sapien
tgatggagtgaattgcrgtatttaacaagaata

SEQ ID NO: 685 - DNA, 33 bp, homo sapien
atctcccttgctcaagrtaatctacttttccta

SEQ ID NO: 686 - DNA, 33 bp, homo sapien
gggcagggagaatattktcacacactcattcag

SEQ ID NO: 687 - DNA, 33 bp, homo sapien
tgggaggatgactggtstgagattttcttgtga

SEQ ID NO: 688 - DNA, 33 bp, homo sapien
tttacatacatctgaamccttgaaacaagtcag

SEQ ID NO: 689 - DNA, 33 bp, homo sapien
ctgccagagtggatatkttgttagccagcatga

SEQ ID NO: 690 - DNA, 33 bp, homo sapien
ctgcagccaaagagctrgttctcctcagtttca

SEQ ID NO: 691 - DNA, 33 bp, homo sapien
aacaacaatgaatctcyacacaataaaacattt

SEQ ID NO: 692 - DNA, 33 bp, homo sapien
tgggtttcactaatatytgattttccctttcaa

SEQ ID NO: 693 - DNA, 33 bp, homo sapien
agatcagtctgttctcmgttttcttttgcagag

SEQ ID NO: 694 - DNA, 33 bp, homo sapien
cacaagatgagtcactstgaccattgaagacag

SEQ ID NO: 695 - DNA, 33 bp, homo sapien
ctagacacacaatgtaygctaaatgtactactt

SEQ ID NO: 696 - DNA, 33 bp, homo sapien
gtccaagatagcctacrggacccaaaaggagga

SEQ ID NO: 697 - DNA, 33 bp, homo sapien
gtaggaggagataggamcaattttcagtggatt

SEQ ID NO: 698 - DNA, 33 bp, homo sapien
ctggtttctttgatttracagacaatgtataga

SEQ ID NO: 699 - DNA, 33 bp, homo sapien
aacataaactttatttstcagcacataattcat

SEQ ID NO: 700 - DNA, 33 bp, homo sapien
aaaatttagttagggaygaattcagattactga

SEQ ID NO: 701 - DNA, 33 bp, homo sapien
agggaaagcacatggaraattagggagaaaggc

SEQ ID NO: 702 - DNA, 33 bp, homo sapien
tgagtgagcaggcaccrgctgtgaccaccatgc

SEQ ID NO: 703 - DNA, 33 bp, homo sapien
atcactcccggcaaggwtcttaaacagatttgt

SEQ ID NO: 704 - DNA, 33 bp, homo sapien
agccttaactgctgggmatttgagaagtctcag

SEQ ID NO: 705 - DNA, 33 bp, homo sapien
aggggaactgttatggmcttcattctaagaagc

SEQ ID NO: 706 - DNA, 33 bp, homo sapien
tatgtttcacttcgacytggaggccagtggagg

SEQ ID NO: 707 - DNA, 33 bp, homo sapien
atgtgaccattcgacayaggtgtggattttccg

SEQ ID NO: 708 - DNA, 33 bp, homo sapien
ttggtagtttgtacacktagctattttcagtac

SEQ ID NO: 709 - DNA, 33 bp, homo sapien
cctgggaggaagctcastttataaaacagggaa

SEQ ID NO: 710 - DNA, 33 bp, homo sapien
gacacagaaagtaggtytgagcagtgaaaaagc

SEQ ID NO: 711 - DNA, 33 bp, homo sapien
gctaaatagactcacayggcaaaaggaaaatgg

SEQ ID NO: 712 - DNA, 33 bp, homo sapien
cccctggtagtatttgyttttgtaataaaggct

SEQ ID NO: 713 - DNA, 33 bp, homo sapien
tcctatttgtttatccrtgagttgtttaatcta

SEQ ID NO: 714 - DNA, 33 bp, homo sapien
caatattgaaaagcagrttccaaagttatcttg

SEQ ID NO: 715 - DNA, 33 bp, homo sapien
tgattttgtcaaacttytgagctgagagagcat

SEQ ID NO: 716 - DNA, 33 bp, homo sapien
atgttaccttcaaaccraaagcttaatcttcaa

SEQ ID NO: 717 - DNA, 33 bp, homo sapien
tgaaagaaagaaggagsacaagagggtcagagg

SEQ ID NO: 718 - DNA, 33 bp, homo sapien
aaggcctacacccttcrtcacatctgcaaagtc

SEQ ID NO: 719 - DNA, 33 bp, homo sapien
agttactattactccayacttcaaggtcaaatg

SEQ ID NO: 720 - DNA, 33 bp, homo sapien
tgaaaagtaagtaaaawataatctgggcatcca

SEQ ID NO: 721 - DNA, 33 bp, homo sapien
agaccctaaagaaatgragatttgtgaattgcc

SEQ ID NO: 722 - DNA, 33 bp, homo sapien
gtctgtgatgatttccrtgtctacaatgcagat

SEQ ID NO: 723 - DNA, 33 bp, homo sapien
tgccacacacctttaaycatatctcatgtgaac

SEQ ID NO: 724 - DNA, 33 bp, homo sapien
ctgaagagaacattgayattaaagagaaaattt

SEQ ID NO: 725 - DNA, 33 bp, homo sapien
ttttatctcaagtgaayctggagaagcaacaat

SEQ ID NO: 726 - DNA, 33 bp, homo sapien
gtgtcaacagaatgcayggtcccaaacaattcc

SEQ ID NO: 727 - DNA, 33 bp, homo sapien
gtcctctgccaaagttstaagttttcatgaaaa

SEQ ID NO: 728 - DNA, 33 bp, homo sapien
ccactggaatggaacaraattaagaaggcctat

SEQ ID NO: 729 - DNA, 33 bp, homo sapien
gatactaaattaaagayaacacggtaccagaaa

SEQ ID NO: 730 - DNA, 33 bp, homo sapien
cttctaaaagtcatacyttgattttcaatactt

SEQ ID NO: 731 - DNA, 33 bp, homo sapien
tcatcatttaatgagcrtcttagttatataacc

SEQ ID NO: 732 - DNA, 33 bp, homo sapien
ttgctaagtaagaatgmatatagtccatcggga

SEQ ID NO: 733 - DNA, 33 bp, homo sapien
tagtcagtgaaagaccrgaggattaaatgggcc

SEQ ID NO: 734 - DNA, 33 bp, homo sapien
tgctggcagcactgtgyggaaggctggctgaaa

SEQ ID NO: 735 - DNA, 33 bp, homo sapien
ccactaactcctggctrctactgtgtatcttct

SEQ ID NO: 736 - DNA, 33 bp, homo sapien
ctgtgcctcaagtaccyaaaacagaccctggga

SEQ ID NO: 737 - DNA, 33 bp, homo sapien
aaaccactttcaaatasagagaggccctctctg

SEQ ID NO: 738 - DNA, 33 bp, homo sapien
gtttagagaggaaaatrggcagcatcattttgt

SEQ ID NO: 739 - DNA, 33 bp, homo sapien
gctgcagcatttacatktttaacaagctaccag

SEQ ID NO: 740 - DNA, 33 bp, homo sapien
actgctgccttagtctyttctgcccttataata

SEQ ID NO: 741 - DNA, 33 bp, homo sapien
caggggcacactaaacrtaagcaatagtaattc

SEQ ID NO: 742 - DNA, 33 bp, homo sapien
ctacaggtaagtttgaraaatgtcttaacagcc

SEQ ID NO: 743 - DNA, 33 bp, homo sapien
gatagatcagtactttwcagccttcctacagca

SEQ ID NO: 744 - DNA, 33 bp, homo sapien
gatgtcttcagattaasttgaaaaccactcccc

SEQ ID NO: 745 - DNA, 33 bp, homo sapien
atttattaacatccaarcaaacttgcagtctat

SEQ ID NO: 746 - DNA, 33 bp, homo sapien
aggcaaagatcttttayttgtggttaggcttac

SEQ ID NO: 747 - DNA, 33 bp, homo sapien
agggatccacttccackatccaaatacctccca

SEQ ID NO: 748 - DNA, 33 bp, homo sapien
aagtttgtggccaaccraaatctccatatgttt

SEQ ID NO: 749 - DNA, 33 bp, homo sapien
aaactccaatctcaccrttggctgactccatct

SEQ ID NO: 750 - DNA, 33 bp, homo sapien
ggtgctctgggtccctsagtatcagagtcaact

SEQ ID NO: 751 - DNA, 33 bp, homo sapien
gaaacggtctccatctstttggtcttgtccaca

SEQ ID NO: 752 - DNA, 33 bp, homo sapien
attcaactggctcatgrctcatactaggggatc

SEQ ID NO: 753 - DNA, 33 bp, homo sapien
caggttaatttactccrgttcctccaaatgaaa

SEQ ID NO: 754 - DNA, 33 bp, homo sapien
aaattgcacttttagayccaacactcagggaag

SEQ ID NO: 755 - DNA, 33 bp, homo sapien
caggatgccttgggtcrttggtcccattccact

SEQ ID NO: 756 - DNA, 33 bp, homo sapien
acatggcgataaacccragaggaaggggcctac

SEQ ID NO: 757 - DNA, 33 bp, homo sapien
gtgttgtgatcaaatartcctcacgtatagggt

SEQ ID NO: 758 - DNA, 33 bp, homo sapien
ctgttgtgtctggtcckctacagtgagaataag

SEQ ID NO: 759 - DNA, 33 bp, homo sapien
ttatctaatcttacaamaacagaacctctgttc

SEQ ID NO: 760 - DNA, 33 bp, homo sapien
catctttgggaggaggsttcttattcatgccct

SEQ ID NO: 761 - DNA, 33 bp, homo sapien
atttatgtgattgccaytggtcaagcctggtca

SEQ ID NO: 762 - DNA, 33 bp, homo sapien
ggaaaccacccagaatrtagcacagagagatac

SEQ ID NO: 763 - DNA, 33 bp, homo sapien
cttttactttagttcaycaaacctagaaccaaa

SEQ ID NO: 764 - DNA, 33 bp, homo sapien
tgtactggaattcacaygcttactgaacttcaa

SEQ ID NO: 765 - DNA, 33 bp, homo sapien
tgcttcacaataacatyggtatgacacaggagc

SEQ ID NO: 766 - DNA, 33 bp, homo sapien
cagctctgcttggcagkgcttagcggtgaacaa

SEQ ID NO: 767 - DNA, 33 bp, homo sapien
agctccaacttgctcawgaaggtggccacagca

SEQ ID NO: 768 - DNA, 33 bp, homo sapien
gaggacaaagagggcaygggctccgcagacagg

SEQ ID NO: 769 - DNA, 33 bp, homo sapien
ctacgcttctgactttscaaaatgcttctgtta

SEQ ID NO: 770 - DNA, 33 bp, homo sapien
gttccaaacaccttccrctggggtcttcagatg

SEQ ID NO: 771 - DNA, 33 bp, homo sapien
gatttctgatttagttkcaagatgtaaaaatcc

SEQ ID NO: 772 - DNA, 33 bp, homo sapien
atgcgcctaatcagcaragatcaatcaaggcag

SEQ ID NO: 773 - DNA, 33 bp, homo sapien
cccataaaggccttcgmtgcgttgaggatgagg

SEQ ID NO: 774 - DNA, 33 bp, homo sapien
gctaactgcagcacagygaagacacggatcttc

SEQ ID NO: 775 - DNA, 33 bp, homo sapien
ctaatgggtttccatgyaccaataaaattcctt

SEQ ID NO: 776 - DNA, 33 bp, homo sapien
cttggattgaaagaaawggctgggaaaattggc

SEQ ID NO: 777 - DNA, 33 bp, homo sapien
ccaatctcaggacatcygctagcaaatctagga

SEQ ID NO: 778 - DNA, 33 bp, homo sapien
caatccaaggaggtccracatccaaataaaata

SEQ ID NO: 779 - DNA, 33 bp, homo sapien
atgccagcagaatgcastaggacctgcaaaggt

SEQ ID NO: 780 - DNA, 33 bp, homo sapien
tagaatgatagaaaagkaaagagtaactacaat

SEQ ID NO: 781 - DNA, 33 bp, homo sapien
cgtggctgggtcactgkgttgttattgcctctc

SEQ ID NO: 782 - DNA, 33 bp, homo sapien
actttcctgatgtcaartctaaaaatcccatga

SEQ ID NO: 783 - DNA, 33 bp, homo sapien
atttcctgttatagccrgtttgtgttggataaa

SEQ ID NO: 784 - DNA, 33 bp, homo sapien
atgcaatgctggagacrtggtgaaataggccaa

SEQ ID NO: 785 - DNA, 33 bp, homo sapien
tacagctccatttccargccactgctacctagt

SEQ ID NO: 786 - DNA, 33 bp, homo sapien
tccaggtgagcccttgytttgcccagtctccgt

SEQ ID NO: 787 - DNA, 33 bp, homo sapien
gtttcatatacctccarttgtaaacacctaaat

SEQ ID NO: 788 - DNA, 33 bp, homo sapien
agaattaattcagaggygctgacacatgctcac

SEQ ID NO: 789 - DNA, 33 bp, homo sapien
agtgtttgcctctaacrtacgtgcatcctcccg

SEQ ID NO: 790 - DNA, 33 bp, homo sapien
gcctttctctgatcctyttccttgtttcgtctg

SEQ ID NO: 791 - DNA, 33 bp, homo sapien
acagaggaaacagtacrtgcagaggccacaggc

SEQ ID NO: 792 - DNA, 33 bp, homo sapien
ccctctatcattttatyctatctgagtccccag

SEQ ID NO: 793 - DNA, 33 bp, homo sapien
ggaactccattgagacrgtagttagacttggta

SEQ ID NO: 794 - DNA, 33 bp, homo sapien
accccacggtttttcargagaagatactgtgtc

SEQ ID NO: 795 - DNA, 33 bp, homo sapien
tatctccttgttttatkaatggaaactagtgaa

SEQ ID NO: 796 - DNA, 33 bp, homo sapien
tttggttgagtgaaacyatgaataaaacaatag

SEQ ID NO: 797 - DNA, 33 bp, homo sapien
taaaataatgtaaaacrtctccataatttttga

SEQ ID NO: 798 - DNA, 33 bp, homo sapien
ttgagctcagaccaatractattctcagtctag

SEQ ID NO: 799 - DNA, 33 bp, homo sapien
gccctcctgtaaatacrccttaagtaaactaga

SEQ ID NO: 800 - DNA, 33 bp, homo sapien
actgccatttccaagtytgggttaatcatttaa

SEQ ID NO: 801 - DNA, 33 bp, homo sapien
taccctttagctattgygaatatttctgcaaag

SEQ ID NO: 802 - DNA, 33 bp, homo sapien
accatcaaattctatgraactcaaaagtgctag

SEQ ID NO: 803 - DNA, 33 bp, homo sapien
ttgaatggttttgactrgccatgactgacttat

SEQ ID NO: 804 - DNA, 33 bp, homo sapien
tgccttcagatgctccratttgggaagcttcca

SEQ ID NO: 805 - DNA, 33 bp, homo sapien
caaaggtcactagaagkatgctcaccaaatgcc

SEQ ID NO: 806 - DNA, 33 bp, homo sapien
caaacataagacctagmtagcccatggtaggca

SEQ ID NO: 807 - DNA, 33 bp, homo sapien
atgtggttatggagaaytcagtcatgagaagat

SEQ ID NO: 808 - DNA, 33 bp, homo sapien
gggtgataagaatgccrattaaatgcacacctg

SEQ ID NO: 809 - DNA, 33 bp, homo sapien
aaaatgccatcccattstcttctgacctataag

SEQ ID NO: 810 - DNA, 33 bp, homo sapien
ctcatcactcagatttratacattttaacattt

SEQ ID NO: 811 - DNA, 33 bp, homo sapien
gaacttttaaagaatcrgagttttttcagaatt

SEQ ID NO: 812 - DNA, 33 bp, homo sapien
gtggtcagatttatgcytgtagaaaaaacaatc

SEQ ID NO: 813 - DNA, 33 bp, homo sapien
ccacaggatatatatcrttctcagctggacaag

SEQ ID NO: 814 - DNA, 33 bp, homo sapien
atcttttatggctgtaygctgaaatgatctagc

SEQ ID NO: 815 - DNA, 33 bp, homo sapien
atgtcaccaatggttgycagcatacactgtcac

SEQ ID NO: 816 - DNA, 33 bp, homo sapien
ctgaactgcatgcattyccaggcttgtcatgtg

SEQ ID NO: 817 - DNA, 33 bp, homo sapien
gagagcagtttttaatytgtgaacgtgtaagtc

SEQ ID NO: 818 - DNA, 33 bp, homo sapien
tttaatcaatcccagaygtttaaccctcaaaac

SEQ ID NO: 819 - DNA, 33 bp, homo sapien
taccttctgtttcagaragaataggttcccaca

SEQ ID NO: 820 - DNA, 33 bp, homo sapien
caatcaggtctcatgamcccagccattcgtcat

SEQ ID NO: 821 - DNA, 33 bp, homo sapien
attttttcagaaagacrgaacagagaaaatgga

SEQ ID NO: 822 - DNA, 33 bp, homo sapien
tgccacaggtctcaggrtaacagatgccctgtc

SEQ ID NO: 823 - DNA, 33 bp, homo sapien
taaaaaatacatctacrccaaaaaagaaaataa

SEQ ID NO: 824 - DNA, 33 bp, homo sapien
actgggtgccagatacrtacaaagccagagaaa

SEQ ID NO: 825 - DNA, 33 bp, homo sapien
cagccattgcagttccrctttgccccacaatga

SEQ ID NO: 826 - DNA, 33 bp, homo sapien
catagggcaaacgattwtgagattgattttcag

SEQ ID NO: 827 - DNA, 33 bp, homo sapien
ttacctaaatctccagyttgccagcttactcta

SEQ ID NO: 828 - DNA, 33 bp, homo sapien
tcggatccacgctgccrtcgtgttccctcagtt

SEQ ID NO: 829 - DNA, 33 bp, homo sapien
aagattgatgcattttktgtatgataaagaatt

SEQ ID NO: 830 - DNA, 33 bp, homo sapien
ggaaaggtggtacaatrtaacaagaaccactaa

SEQ ID NO: 831 - DNA, 33 bp, homo sapien
agacacaaccgagtagyggagccaagatttgac

SEQ ID NO: 832 - DNA, 33 bp, homo sapien
gaacttcaacgacttamaatcatctgcatctcc

SEQ ID NO: 833 - DNA, 33 bp, homo sapien
ctctgtggcactcattwatagagtctgcactca

SEQ ID NO: 834 - DNA, 33 bp, homo sapien
gatgccatgagaaagcytgtcaatcctgctgtc

SEQ ID NO: 835 - DNA, 33 bp, homo sapien
tcactttagacagtaayagaaagtataaaataa

SEQ ID NO: 836 - DNA, 33 bp, homo sapien
atttaaatcacaatacracattccctttggata

SEQ ID NO: 837 - DNA, 33 bp, homo sapien
acatggacaaacaagtmagaagtttcccaagca

SEQ ID NO: 838 - DNA, 33 bp, homo sapien
ttcaggataatgtgaamtatggcctaatttttg

SEQ ID NO: 839 - DNA, 33 bp, homo sapien
aggaaggaaataccacygcttcttatgcataca

SEQ ID NO: 840 - DNA, 33 bp, homo sapien
aaattaaaattagaacyacattgtttgcttatc

SEQ ID NO: 841 - DNA, 33 bp, homo sapien
ttatatttgggaacaaytctttggcagggctgg

SEQ ID NO: 842 - DNA, 33 bp, homo sapien
ttttcattctagacagmgaagttgaaaatcatg

SEQ ID NO: 843 - DNA, 33 bp, homo sapien
tttctattaaagtggcmatgcaccatgcacaac

SEQ ID NO: 844 - DNA, 33 bp, homo sapien
tgtaatgccgaatttaygaacagctgtggtatg

SEQ ID NO: 845 - DNA, 33 bp, homo sapien
gtgtgagccctaaatgwcatcatgtgtccacaa

SEQ ID NO: 846 - DNA, 33 bp, homo sapien
cagagagagccttattytgtggcagggcggcta

SEQ ID NO: 847 - DNA, 33 bp, homo sapien
cgagcaatgctattacyggttgagtatccctta

SEQ ID NO: 848 - DNA, 33 bp, homo sapien
ctatctacttgccgttrtttacatttatgtctg

SEQ ID NO: 849 - DNA, 33 bp, homo sapien
tgtcataagatatgaayagcaaatgtttgttta

SEQ ID NO: 850 - DNA, 33 bp, homo sapien
aaagcctggtctttttyggctgaatggcttcag

SEQ ID NO: 851 - DNA, 33 bp, homo sapien
aattagaaaactgtacrctttccacatttgtgg

SEQ ID NO: 852 - DNA, 33 bp, homo sapien
ttattttctttctttgscttacattccttattt

SEQ ID NO: 853 - DNA, 33 bp, homo sapien
gcttagcactaggatgyaagttgcaggacagca

SEQ ID NO: 854 - DNA, 33 bp, homo sapien
agtgtaggtagttaagrgaaagtcaggcacact

SEQ ID NO: 855 - DNA, 33 bp, homo sapien
cagttgcctaatcgatsgaaagagggcatcgga

SEQ ID NO: 856 - DNA, 33 bp, homo sapien
aggacagactttctggragaaataaaagtgtca

SEQ ID NO: 857 - DNA, 33 bp, homo sapien
gagattgaactaggctytgaggagataattaaa

SEQ ID NO: 858 - DNA, 33 bp, homo sapien
gacagagggtctccaayaggatgggcttaactt

SEQ ID NO: 859 - DNA, 33 bp, homo sapien
ccaaaaccttctgtagraatatagtgtcagtat

SEQ ID NO: 860 - DNA, 33 bp, homo sapien
ccctgtgacttttggcmggtcacatgtgctgtc

SEQ ID NO: 861 - DNA, 33 bp, homo sapien
tcaaatctctgcaacaraatgccaggtgtagag

SEQ ID NO: 862 - DNA, 33 bp, homo sapien
tgtacatccctgattgwttataactctccaact

SEQ ID NO: 863 - DNA, 33 bp, homo sapien
ttttcctgaactatacrtggtaggatactctct

SEQ ID NO: 864 - DNA, 33 bp, homo sapien
tccctattccagggtgrcagactcctagctaag

SEQ ID NO: 865 - DNA, 33 bp, homo sapien
gagcagcttgaagcatytgtgacatctgtgaca

SEQ ID NO: 866 - DNA, 33 bp, homo sapien
tgaaagctgctgaaaawcttcagaaactgtctt

SEQ ID NO: 867 - DNA, 33 bp, homo sapien
atcaagtgtttgctctwtaactggatcattcaa

SEQ ID NO: 868 - DNA, 33 bp, homo sapien
gcacaaaaccatttctytgtcaagggaaaatga

SEQ ID NO: 869 - DNA, 33 bp, homo sapien
tggcctaggcaagcacrgaatgcccatgttcca

SEQ ID NO: 870 - DNA, 33 bp, homo sapien
tgtcatcagtagattgytgaaaaatattccaca

SEQ ID NO: 871 - DNA, 33 bp, homo sapien
ctctgtctttaactcargtatagtaatagatga

SEQ ID NO: 872 - DNA, 33 bp, homo sapien
ggaggagctaaagtcaytgggaacagcccttag

SEQ ID NO: 873 - DNA, 33 bp, homo sapien
cctttccaagcgcggtyggctgtgtcagggctg

SEQ ID NO: 874 - DNA, 33 bp, homo sapien
atacacacatttgtgcrtaaatacacaggcata

SEQ ID NO: 875 - DNA, 33 bp, homo sapien
ctctctttgacgttgaycttcctgccatactct

SEQ ID NO: 876 - DNA, 33 bp, homo sapien
gacagaggtaactgtgkccaagattcaagaagg

SEQ ID NO: 877 - DNA, 33 bp, homo sapien
gtgttaccatcctgccrttcagaggagggaagt

SEQ ID NO: 878 - DNA, 33 bp, homo sapien
gcatccctcagctccamccagaatactgcgata

SEQ ID NO: 879 - DNA, 33 bp, homo sapien
atttcattctccatcakctcactttccattttt

SEQ ID NO: 880 - DNA, 33 bp, homo sapien
tgaccatctattgcacrgattattgtttaaagt

SEQ ID NO: 881 - DNA, 33 bp, homo sapien
gctaagatattgctaargagaagtagctgagat

SEQ ID NO: 882 - DNA, 33 bp, homo sapien
aggaagggtcatctacrtggatactgaaatcac

SEQ ID NO: 883 - DNA, 33 bp, homo sapien
ttcagctatttgtttasattccacttgcatttc

SEQ ID NO: 884 - DNA, 33 bp, homo sapien
attcttggtttttgacrtctgaaaagccctgca

SEQ ID NO: 885 - DNA, 33 bp, homo sapien
tcaaattttcctgtgcyaaatttttatgtgatg

SEQ ID NO: 886 - DNA, 33 bp, homo sapien
gcttatttttctgtttrtttaaggctgattgga

SEQ ID NO: 887 - DNA, 33 bp, homo sapien
aaaagggggaacagccrtgtcttctgaaacact

SEQ ID NO: 888 - DNA, 33 bp, homo sapien
tcatgtgcccaaaatgsagtcagtaggagataa

SEQ ID NO: 889 - DNA, 33 bp, homo sapien
cagatgaggacactgakactaagatgtgaagtg

SEQ ID NO: 890 - DNA, 33 bp, homo sapien
aaaggtttgattccaartgctctggaaagaaaa

SEQ ID NO: 891 - DNA, 33 bp, homo sapien
ttctgcagtttataagrcacctagtttatggta

SEQ ID NO: 892 - DNA, 33 bp, homo sapien
atggattcctgttactkcataagaaacctttcc

SEQ ID NO: 893 - DNA, 33 bp, homo sapien
cctttggtgaccttaaktgagttgctcaccttc

SEQ ID NO: 894 - DNA, 33 bp, homo sapien
gggagggatgatgttayccagagcccagaaaat

SEQ ID NO: 895 - DNA, 33 bp, homo sapien
ccacctgctgcccagcsaggtgtccttgttcag

SEQ ID NO: 896 - DNA, 33 bp, homo sapien
ctcagcacacggcatcrcacccagtcctctcca

SEQ ID NO: 897 - DNA, 33 bp, homo sapien
aagattgcatttgaackatatacttcaacttta

SEQ ID NO: 898 - DNA, 33 bp, homo sapien
gtttaagccatgctggmgtggtgctcacagggt

SEQ ID NO: 899 - DNA, 33 bp, homo sapien
tggactataaagaagamcaaagtgtggcatgtt

SEQ ID NO: 900 - DNA, 33 bp, homo sapien
gttccatgaaaaccaaygctttgtctctgaaat

SEQ ID NO: 901 - DNA, 33 bp, homo sapien
ggaattaacaaacagcstaaactctttcacctg

SEQ ID NO: 902 - DNA, 33 bp, homo sapien
gatgactgagatgtcaraatcccatctcttccc

SEQ ID NO: 903 - DNA, 33 bp, homo sapien
gtgtctcaacatcattsgctatgctgagctgct

SEQ ID NO: 904 - DNA, 33 bp, homo sapien
tgtattttggtagacawatgcagtatgtgtggt

SEQ ID NO: 905 - DNA, 33 bp, homo sapien
atctactttcttagcastttttgagtatatctt

SEQ ID NO: 906 - DNA, 33 bp, homo sapien
ttttctatgtgagggaytaaaaaaacctgagta

SEQ ID NO: 907 - DNA, 33 bp, homo sapien
ggcagagctttgagcartacacatgctcatcaa

SEQ ID NO: 908 - DNA, 33 bp, homo sapien
cgggaatgacagacatmatcaacagttagccag

SEQ ID NO: 909 - DNA, 33 bp, homo sapien
tgtgtcaccatgccagsctaaggtttgtagttt

SEQ ID NO: 910 - DNA, 33 bp, homo sapien
cctgagagtgtgctccrgtaaatttcctgcata

SEQ ID NO: 911 - DNA, 33 bp, homo sapien
tgataacttacgaattrtatattgcaagttatg

SEQ ID NO: 912 - DNA, 33 bp, homo sapien
tcagcatacttcaaacmattcctttaaactatg

SEQ ID NO: 913 - DNA, 33 bp, homo sapien
tgcaaaaccacctttaytatgtaagttaatata

SEQ ID NO: 914 - DNA, 33 bp, homo sapien
tagaaggaaagaacaaytctaccaactaattcc

SEQ ID NO: 915 - DNA, 33 bp, homo sapien
gtattttctgtaatgaytttcagagtgcacatg

SEQ ID NO: 916 - DNA, 33 bp, homo sapien
gaacacagcagggaacmaccttgtacatacatc

SEQ ID NO: 917 - DNA, 33 bp, homo sapien
agtctctaacccagtcrttttgtagcccagatg

SEQ ID NO: 918 - DNA, 33 bp, homo sapien
acacaatactatttacrttaacaccaaacaatt

SEQ ID NO: 919 - DNA, 33 bp, homo sapien
tgttactggcttgaagkttgatgaaaatcccct

SEQ ID NO: 920 - DNA, 33 bp, homo sapien
attcaatgcttggaaakgaagtttaagttggag

SEQ ID NO: 921 - DNA, 33 bp, homo sapien
aaatacttatgcaagtragtcagattttgtttt

SEQ ID NO: 922 - DNA, 33 bp, homo sapien
gacatacaagaacatgyggttccacagcagtcc

SEQ ID NO: 923 - DNA, 33 bp, homo sapien
cagcttccaagctaagwccatgtgcgccctgtg

SEQ ID NO: 924 - DNA, 33 bp, homo sapien
atttcctgtatttacawagctccctgttttatt

SEQ ID NO: 925 - DNA, 33 bp, homo sapien
aaggtggctgatgaaamattatcttgatgctta

SEQ ID NO: 926 - DNA, 33 bp, homo sapien
taagattatctcctgcrtagagagacgatagtc

SEQ ID NO: 927 - DNA, 33 bp, homo sapien
tgggcctcaaatgatasttatgactttaaaagt

SEQ ID NO: 928 - DNA, 33 bp, homo sapien
actcctgaactactgcrgggtaatcagagtagc

SEQ ID NO: 929 - DNA, 33 bp, homo sapien
aagcaaaggtacagaargcagagttattcatcc

SEQ ID NO: 930 - DNA, 33 bp, homo sapien
ttctgattagccaactrtcaacatcgggtacat

SEQ ID NO: 931 - DNA, 33 bp, homo sapien
tctctgcagattaatcyacttccatgctaccac

SEQ ID NO: 932 - DNA, 33 bp, homo sapien
tttgggcatatgctttrttatgtatgcatacag

SEQ ID NO: 933 - DNA, 33 bp, homo sapien
aggcagcttaattagcsaggtgtcctgcaggca

SEQ ID NO: 934 - DNA, 33 bp, homo sapien
aaaggagccagcaatcrgtcctccaaggactca

SEQ ID NO: 935 - DNA, 33 bp, homo sapien
gaaagcctatcttttgmgagcatggtttagtga

SEQ ID NO: 936 - DNA, 33 bp, homo sapien
ttagcaatgactcatgmtgtaaaattggaatgt

SEQ ID NO: 937 - DNA, 33 bp, homo sapien
ggctgagtaaggtcacmggaaaagatgtcaaga

SEQ ID NO: 938 - DNA, 33 bp, homo sapien
atcatggaaggtgtgawctttgaaaatttgaca

SEQ ID NO: 939 - DNA, 33 bp, homo sapien
ctgtggtggcccaaaakgcgtcatcagctgtca

SEQ ID NO: 940 - DNA, 33 bp, homo sapien
atcactggaattataayagacatgtgctcagaa

SEQ ID NO: 941 - DNA, 33 bp, homo sapien
aagagccagatgcttgyaaaggacaggtgtatt

SEQ ID NO: 942 - DNA, 33 bp, homo sapien
agagaccttgcctgtcktgttcacctgtcccca

SEQ ID NO: 943 - DNA, 33 bp, homo sapien
gagagctacaaaatccrgtgcaaagctgtttta

SEQ ID NO: 944 - DNA, 33 bp, homo sapien
caaagatagagattttyggttttatccattgat

SEQ ID NO: 945 - DNA, 33 bp, homo sapien
caggggtgacacaaggyatgcagaaaccctcga

SEQ ID NO: 946 - DNA, 33 bp, homo sapien
aacattagatcataccstgtttgtcctatcata

SEQ ID NO: 947 - DNA, 33 bp, homo sapien
atgatagttttctcctstgtcctcacttggtca

SEQ ID NO: 948 - DNA, 33 bp, homo sapien
acaactatctaactcakaccaatgggtggccta

SEQ ID NO: 949 - DNA, 33 bp, homo sapien
ttcttagctattaactytcaattactagacatt

SEQ ID NO: 950 - DNA, 33 bp, homo sapien
tgcttttcgcaatttgrtcatgaaatttttgcc

SEQ ID NO: 951 - DNA, 33 bp, homo sapien
gtaaacaaccagacttyggaatagttggacaga

SEQ ID NO: 952 - DNA, 33 bp, homo sapien
ggtaggtaaaaatacarttaggcagaactctga

SEQ ID NO: 953 - DNA, 33 bp, homo sapien
tttgactctatttgggktgttatcttttggtta

SEQ ID NO: 954 - DNA, 33 bp, homo sapien
agttctccctcactttyccagagcatctatgag

SEQ ID NO: 955 - DNA, 33 bp, homo sapien
tacactgtatcagctcrtcatctgcagttacta

SEQ ID NO: 956 - DNA, 33 bp, homo sapien
tgcagacataaagaagmaggcatggggtgaaga

SEQ ID NO: 957 - DNA, 33 bp, homo sapien
ctgcctgctgaccatgytcctcgcaacagggca

SEQ ID NO: 958 - DNA, 33 bp, homo sapien
aaagaggtctattttcrtaactagaagacgaaa

SEQ ID NO: 959 - DNA, 33 bp, homo sapien
aaacataattctaattytcacagctaaacaatt

SEQ ID NO: 960 - DNA, 33 bp, homo sapien
tagcagactcaattatwtaaaagccattatgca

SEQ ID NO: 961 - DNA, 33 bp, homo sapien
ctcaccaaggcaacaaygattactcaccagcag

SEQ ID NO: 962 - DNA, 33 bp, homo sapien
gtatttttaggtgttgrataaatgagtcaatcc

SEQ ID NO: 963 - DNA, 33 bp, homo sapien
tctaaatataacatcarttgactttccactgta

SEQ ID NO: 964 - DNA, 33 bp, homo sapien
gtagggatacagtaaayagggccattgatagtt

SEQ ID NO: 965 - DNA, 33 bp, homo sapien
ttgaccaggttaggccragttgagagtccttgg

SEQ ID NO: 966 - DNA, 33 bp, homo sapien
cactgcatttggacccrcaggtaataggtggca

SEQ ID NO: 967 - DNA, 33 bp, homo sapien
ttatgagaataattatsacaaaaatgccttgac

SEQ ID NO: 968 - DNA, 33 bp, homo sapien
ttcattcacacattgayggacattcaggttgtt

SEQ ID NO: 969 - DNA, 33 bp, homo sapien
cctgtgtaggctaagcytctgtttggtattccc

SEQ ID NO: 970 - DNA, 33 bp, homo sapien
acatgtattactcacartttttgccatggtctc

SEQ ID NO: 971 - DNA, 33 bp, homo sapien
ataccttgcctggctawactttattctcttctt

SEQ ID NO: 972 - DNA, 33 bp, homo sapien
gtggattaagagttgtrcggcttggattgtagt

SEQ ID NO: 973 - DNA, 33 bp, homo sapien
ttctctctctccaaatyggagtgtcagatgcta

SEQ ID NO: 974 - DNA, 33 bp, homo sapien
tgagcaagaaataatcrtctgtgtactaagtca

SEQ ID NO: 975 - DNA, 33 bp, homo sapien
aggggattctactgtasagcaagttgagaacca

SEQ ID NO: 976 - DNA, 33 bp, homo sapien
ctagaatattgtggaarcaaacagaatgcactc

SEQ ID NO: 977 - DNA, 33 bp, homo sapien
gggggcctgcagtggasgagtctatcatgtttt

SEQ ID NO: 978 - DNA, 33 bp, homo sapien
acaatttttttcccagrctatttttgacctata

SEQ ID NO: 979 - DNA, 33 bp, homo sapien
ttttctaaaatccttgraagatcccactagggc

SEQ ID NO: 980 - DNA, 33 bp, homo sapien
tattgtgattctaaatkacaggagcagcagcca

SEQ ID NO: 981 - DNA, 33 bp, homo sapien
tggtatagctcaatacrtcagtgcaagctgaaa

SEQ ID NO: 982 - DNA, 33 bp, homo sapien
cttttcctgtcatgccrccttgctccctggcta

SEQ ID NO: 983 - DNA, 33 bp, homo sapien
caaaacatttgctagamgaattgtctttttttt

SEQ ID NO: 984 - DNA, 33 bp, homo sapien
aaagattatctaaaacrgatgaagattaagctg

SEQ ID NO: 985 - DNA, 33 bp, homo sapien
tttttgctttaagttcrgctctcaaaatcattt

SEQ ID NO: 986 - DNA, 33 bp, homo sapien
taggttgaccttcagayttattttctcaatggg

SEQ ID NO: 987 - DNA, 33 bp, homo sapien
gggacgttatcaagaawgaggaattttgctaaa

SEQ ID NO: 988 - DNA, 33 bp, homo sapien
tcctatagtaatcacartaatggcagcatttgc

SEQ ID NO: 989 - DNA, 33 bp, homo sapien
tccagaaaaacttctgktactcattaggcccat

SEQ ID NO: 990 - DNA, 33 bp, homo sapien
gatttcacttgtcttcmatttagaaagctctat

SEQ ID NO: 991 - DNA, 33 bp, homo sapien
tgtcaaatcagctgtgrcattagactctcacag

SEQ ID NO: 992 - DNA, 33 bp, homo sapien
tataagcatatggcatytcctcagcttggactt

SEQ ID NO: 993 - DNA, 33 bp, homo sapien
ctgaatccagataaaaytgtttttttcctaagc

SEQ ID NO: 994 - DNA, 33 bp, homo sapien
attttcaaatcttaagkcagcattttctccaga

SEQ ID NO: 995 - DNA, 33 bp, homo sapien
agaaagatcactgaagrtttgagaaacataatt

SEQ ID NO: 996 - DNA, 33 bp, homo sapien
ccttactaattcaaagytgtagtttttgtgact

SEQ ID NO: 997 - DNA, 33 bp, homo sapien
gcctgggtgtttgtggmgatggatggatccttc

SEQ ID NO: 998 - DNA, 33 bp, homo sapien
tctgttgtttctgatgrctctcataatggcatg

SEQ ID NO: 999 - DNA, 33 bp, homo sapien
catctttcctgaggctstcttagaatactgcaa

SEQ ID NO: 1000 - DNA, 33 bp, homo sapien
tcatacacgtaaatctyaatctggaaggaagat

SEQ ID NO: 1001 - DNA, 33 bp, homo sapien
cgttgactgaaatgtcrttatgtggtatgtgac

SEQ ID NO: 1002 - DNA, 33 bp, homo sapien
ttctctccataggtctyatgccacattttgctg

SEQ ID NO: 1003 - DNA, 33 bp, homo sapien
cattgatcatctaatcyaattccttcagtgact

SEQ ID NO: 1004 - DNA, 33 bp, homo sapien
gtactggagtagacacmctaacacataaattga

SEQ ID NO: 1005 - DNA, 33 bp, homo sapien
ctaaaaaccacagagarcaatgtaataggaaac

SEQ ID NO: 1006 - DNA, 33 bp, homo sapien
tctctctaaaatagttytctaagttgctctcct

SEQ ID NO: 1007 - DNA, 33 bp, homo sapien
gactaataccgctgaaycaactcattcaaagat

SEQ ID NO: 1008 - DNA, 33 bp, homo sapien
gtacctgactacgaacraaaggagaacagatgc

SEQ ID NO: 1009 - DNA, 33 bp, homo sapien
tgccagatgatactccyaaaacttaggtatatt

SEQ ID NO: 1010 - DNA, 33 bp, homo sapien
tgcagaaagacagaaayagacaggaactttctc

SEQ ID NO: 1011 - DNA, 33 bp, homo sapien
tgattaaaatggagacygcctgaacttgggtgc

SEQ ID NO: 1012 - DNA, 33 bp, homo sapien
tggggggtcctgtgtamctctacatcagatatt

SEQ ID NO: 1013 - DNA, 33 bp, homo sapien
tttttgcaagaaggcayaatttaatcaggattg

SEQ ID NO: 1014 - DNA, 33 bp, homo sapien
ggaaatgctgaaaaatmtaaaaagtgttgtgga

SEQ ID NO: 1015 - DNA, 33 bp, homo sapien
tgtgataaaaacagtcrtagaatggataaccca

SEQ ID NO: 1016 - DNA, 33 bp, homo sapien
gcatgtttccatttatrtgaaattcaataagag

SEQ ID NO: 1017 - DNA, 33 bp, homo sapien
aagtgattaagaaacayttctgccaccctccat

SEQ ID NO: 1018 - DNA, 33 bp, homo sapien
actaagagctaaaagtsggtcacacaagatata

SEQ ID NO: 1019 - DNA, 33 bp, homo sapien
caagagccctattcatrtgtggcctgcttaatg

SEQ ID NO: 1020 - DNA, 33 bp, homo sapien
aaatgctactgactttyatacaatggcttttta

SEQ ID NO: 1021 - DNA, 33 bp, homo sapien
gaacaccaaagaaagaraaaatcttaaaagcaa

SEQ ID NO: 1022 - DNA, 33 bp, homo sapien
gctcaatagagctacgmgtctctgtattctcct

SEQ ID NO: 1023 - DNA, 33 bp, homo sapien
acttcaacaatgttacrtaaaaggaatcacatg

SEQ ID NO: 1024 - DNA, 33 bp, homo sapien
tggctctaccttgtatygttctatggaaatttt

SEQ ID NO: 1025 - DNA, 33 bp, homo sapien
tcacacagtttcttctytgtgcatgtgataaaa

SEQ ID NO: 1026 - DNA, 33 bp, homo sapien
acaagagcatagacaargcattaggagacatag

SEQ ID NO: 1027 - DNA, 33 bp, homo sapien
tagatattagttgttaytcatttgtgagaaaac

SEQ ID NO: 1028 - DNA, 33 bp, homo sapien
tcagagcttttggaccycttttctgaacatagt

SEQ ID NO: 1029 - DNA, 33 bp, homo sapien
tattatagacatttcartagttgcccagctttg

SEQ ID NO: 1030 - DNA, 33 bp, homo sapien
atcctctaagtaacagsctgaaagaacacagaa

SEQ ID NO: 1031 - DNA, 33 bp, homo sapien
gattttgcaattctttrctctaatccattattt

SEQ ID NO: 1032 - DNA, 33 bp, homo sapien
tatgagatggaattccraagccaattcagcatt

SEQ ID NO: 1033 - DNA, 33 bp, homo sapien
agaagatactcggtctycttaattcaggatcta

SEQ ID NO: 1034 - DNA, 33 bp, homo sapien
tgccaggctcttttcarcaactagttctcatgg

SEQ ID NO: 1035 - DNA, 33 bp, homo sapien
gtgtgaaatataattgytaaatatggttttgaa

SEQ ID NO: 1036 - DNA, 33 bp, homo sapien
tcatctgctagcagggmtcagtgagggatggct

SEQ ID NO: 1037 - DNA, 33 bp, homo sapien
ttgttccgcctctagcrctcttttgcctgccca

SEQ ID NO: 1038 - DNA, 33 bp, homo sapien
agactggagattacagygcattctttctagcac

SEQ ID NO: 1039 - DNA, 33 bp, homo sapien
aatatcctaaattttgyctacctccagtttaac

SEQ ID NO: 1040 - DNA, 33 bp, homo sapien
tttgtgctcgtggagaygctggtggtttgtaga

SEQ ID NO: 1041 - DNA, 33 bp, homo sapien
ctcccatcttgagcgtrttgccttatctgcatg

SEQ ID NO: 1042 - DNA, 33 bp, homo sapien
gcacccaagtgagaatytttaatcacatccaaa

SEQ ID NO: 1043 - DNA, 33 bp, homo sapien
ccattggaaagacatcrgaaataccaagaggaa

SEQ ID NO: 1044 - DNA, 33 bp, homo sapien
aagatgattttcatggytttttatcatttgttg

SEQ ID NO: 1045 - DNA, 33 bp, homo sapien
aataataacatgacacyagttttcagatggggt

SEQ ID NO: 1046 - DNA, 33 bp, homo sapien
atctcggccaatagccrtgatgactactggagg

SEQ ID NO: 1047 - DNA, 33 bp, homo sapien
cttcctgacttcaggtrcaaagcatcaatggaa

SEQ ID NO: 1048 - DNA, 33 bp, homo sapien
tataaaagagatttcaktaggtgcattggaatg

SEQ ID NO: 1049 - DNA, 33 bp, homo sapien
ctagctgacagatcttmaagtggctgagcaatg

SEQ ID NO: 1050 - DNA, 33 bp, homo sapien
gagaaggattcagttamgtttgttcatcttttg

SEQ ID NO: 1051 - DNA, 33 bp, homo sapien
ggtttcttcttcacttrcccgcaagcaccctat

SEQ ID NO: 1052 - DNA, 33 bp, homo sapien
agtgttacaaagttagycagatctcaataaaaa

SEQ ID NO: 1053 - DNA, 33 bp, homo sapien
aaaagcaaccaactcaratttgctaatccaaca

SEQ ID NO: 1054 - DNA, 33 bp, homo sapien
agatgaggaagcaggcragaatatgtgggtggt

SEQ ID NO: 1055 - DNA, 33 bp, homo sapien
ctgtttcctaacctctraggcatttcagaagct

SEQ ID NO: 1056 - DNA, 33 bp, homo sapien
ttgtgtttttttctgcrgtgattcagcaattat

SEQ ID NO: 1057 - DNA, 33 bp, homo sapien
gaagtcattgattcaasaatagctagaaagtgg

SEQ ID NO: 1058 - DNA, 33 bp, homo sapien
ctgcacagaagaagagrgaagtcagggtatttc

SEQ ID NO: 1059 - DNA, 33 bp, homo sapien
tacagaattacactttwatgccctcaaatatgg

SEQ ID NO: 1060 - DNA, 33 bp, homo sapien
caatcaaaggtaaccarctatccgaactgtgtt

SEQ ID NO: 1061 - DNA, 33 bp, homo sapien
acttaccaatttttttrtgtgtcagccagttac

SEQ ID NO: 1062 - DNA, 33 bp, homo sapien
ctagcctgtaattatcrgtgcctatatcctctc

SEQ ID NO: 1063 - DNA, 33 bp, homo sapien
agagctaatgaaatacrtaactgcctggttata

SEQ ID NO: 1064 - DNA, 33 bp, homo sapien
tgcaactaggaggcaayggcgagggagctttaa

SEQ ID NO: 1065 - DNA, 33 bp, homo sapien
ttacctttttatgtggytaacttcaataagcta

SEQ ID NO: 1066 - DNA, 33 bp, homo sapien
ctgcatggctcacccasaagtcagtgaagactg

SEQ ID NO: 1067 - DNA, 33 bp, homo sapien
tgtattctactttgagycatacagctgtgaaga

SEQ ID NO: 1068 - DNA, 33 bp, homo sapien
atgttccaacaaacccrttcataggtatacacc

SEQ ID NO: 1069 - DNA, 33 bp, homo sapien
gtgcaaacaaaggaacmgagacagtcaaagaac

SEQ ID NO: 1070 - DNA, 33 bp, homo sapien
actcaggtaaacaaagkgagcatgacatggaag

SEQ ID NO: 1071 - DNA, 33 bp, homo sapien
ttgaaatgtggttgacyaacatcatcagatcct

SEQ ID NO: 1072 - DNA, 33 bp, homo sapien
cccttcgtttggaattmtcttctagtataaaag

SEQ ID NO: 1073 - DNA, 33 bp, homo sapien
acatgaagcatgtggcstgtactttctaaacat

SEQ ID NO: 1074 - DNA, 33 bp, homo sapien
aagttcaacaatttttwaatcagggtttcaatg

SEQ ID NO: 1075 - DNA, 33 bp, homo sapien
tgccaatcatggaatgstcagggatcagaattc

SEQ ID NO: 1076 - DNA, 33 bp, homo sapien
tgctacttggtgcaatrtcttatacaaagctct

SEQ ID NO: 1077 - DNA, 33 bp, homo sapien
tattttttatgatctgwgtattcactggagaat

SEQ ID NO: 1078 - DNA, 33 bp, homo sapien
tatcagaatcttgagtscaataattaggtaagg

SEQ ID NO: 1079 - DNA, 33 bp, homo sapien
aaatgtagtctctaccytgaccatgtgccttgt

SEQ ID NO: 1080 - DNA, 33 bp, homo sapien
caagatggacttttccygagaggcttagaacag

SEQ ID NO: 1081 - DNA, 33 bp, homo sapien
aaaatgaggacatgtcraaatcacaatttaatg

SEQ ID NO: 1082 - DNA, 33 bp, homo sapien
acaacattctgtgaaayctttcaaagaggaatg

SEQ ID NO: 1083 - DNA, 33 bp, homo sapien
cataactcttttgaacrtacaattcggtgactt

SEQ ID NO: 1084 - DNA, 33 bp, homo sapien
agtatgttctgggaatygctccatatcaataga

SEQ ID NO: 1085 - DNA, 33 bp, homo sapien
tatgacccaccctatcytagtatgacttcacct

SEQ ID NO: 1086 - DNA, 33 bp, homo sapien
ttttccggatatcagcwccaactaaacttttac

SEQ ID NO: 1087 - DNA, 33 bp, homo sapien
gatttaatatagattcyaaatttctcctcttat

SEQ ID NO: 1088 - DNA, 33 bp, homo sapien
aaggggatgccatgtayaccactggatttgctg

SEQ ID NO: 1089 - DNA, 33 bp, homo sapien
atattgtctggttttgrcaatcatagtatcttt

SEQ ID NO: 1090 - DNA, 33 bp, homo sapien
agataaattagtaaaamaaatagtgtgtcaaat

SEQ ID NO: 1091 - DNA, 33 bp, homo sapien
caaccctatttttgctygctggttatatcctct

SEQ ID NO: 1092 - DNA, 33 bp, homo sapien
aagatctctttatgctstcacatgctgcatctc

SEQ ID NO: 1093 - DNA, 33 bp, homo sapien
ataaacatttagattgktgtaagcctttgacta

SEQ ID NO: 1094 - DNA, 33 bp, homo sapien
ctgacccagatctttcmtatatattgtgtcatc

SEQ ID NO: 1095 - DNA, 33 bp, homo sapien
catcactaagtctaatrgttcctactgccagaa

SEQ ID NO: 1096 - DNA, 33 bp, homo sapien
ttttagaacaaaaactycaaaagtgaaatggag

SEQ ID NO: 1097 - DNA, 33 bp, homo sapien
cccatgtagcctctatsctgaccttaggcagca

SEQ ID NO: 1098 - DNA, 33 bp, homo sapien
tgatgtctcagtcttcrtctactttctcagtct

SEQ ID NO: 1099 - DNA, 33 bp, homo sapien
atactgaagcaacagcratcgtattcatagtca

SEQ ID NO: 1100 - DNA, 33 bp, homo sapien
ttttgtgcaactcagtrctttaacaagactgaa

SEQ ID NO: 1101 - DNA, 33 bp, homo sapien
aacaaatctcaaggagwataaattgatacttcc

SEQ ID NO: 1102 - DNA, 33 bp, homo sapien
agcaatttagcttccayctttttttgaggtctt

SEQ ID NO: 1103 - DNA, 33 bp, homo sapien
ataaaagaagtgaaacrggataaaatgagtaga

SEQ ID NO: 1104 - DNA, 33 bp, homo sapien
taatcaaaaaagcatgrtattagtacaaagaca

SEQ ID NO: 1105 - DNA, 33 bp, homo sapien
ctttcttaaggcttttwgtatccatgaaggtcc

SEQ ID NO: 1106 - DNA, 33 bp, homo sapien
catatatggtctgaccrttgtctgtttgtatat

SEQ ID NO: 1107 - DNA, 33 bp, homo sapien
tggtaaagttgttgccyctgactcagattatga

SEQ ID NO: 1108 - DNA, 33 bp, homo sapien
cccccttatggcacccyattgctgctttctttc

SEQ ID NO: 1109 - DNA, 33 bp, homo sapien
aattcatgctgttaaartggctgagtatatacc

SEQ ID NO: 1110 - DNA, 33 bp, homo sapien
tacacagctagtaaatrgtagacccaggacttg

SEQ ID NO: 1111 - DNA, 33 bp, homo sapien
ccaacgtgactctaccrtgaccctagaataaat

SEQ ID NO: 1112 - DNA, 33 bp, homo sapien
ttagattcaaatccacwttccacttaatatccc

SEQ ID NO: 1113 - DNA, 33 bp, homo sapien
aatacagtaaatgcagygagaagaatgagtaga

SEQ ID NO: 1114 - DNA, 33 bp, homo sapien
tcactgcacagtcacaytgctgtacttaaactg

SEQ ID NO: 1115 - DNA, 33 bp, homo sapien
ctttaagcttattaaaytccatgacacagtcat

SEQ ID NO: 1116 - DNA, 33 bp, homo sapien
gtcttgatatttataargcagaaaaaatctcta

SEQ ID NO: 1117 - DNA, 33 bp, homo sapien
gtagaaaatgttacctytgatcccttattttat

SEQ ID NO: 1118 - DNA, 33 bp, homo sapien
cttctccttagttaccrgtaagactgcttttat

SEQ ID NO: 1119 - DNA, 33 bp, homo sapien
aggttacaactatataygtttatggccttcagg

SEQ ID NO: 1120 - DNA, 33 bp, homo sapien
gatgggcacaaagacayggagaattccaggtgg

SEQ ID NO: 1121 - DNA, 33 bp, homo sapien
ccaccccagccaatagrgatcaatctagctata

SEQ ID NO: 1122 - DNA, 33 bp, homo sapien
cagtcctgctgaagctrttcccaaaaaatcaaa

SEQ ID NO: 1123 - DNA, 33 bp, homo sapien
gcttggaggaggtcagwctttgtcctatttagg

SEQ ID NO: 1124 - DNA, 33 bp, homo sapien
aaatcagcctcagaatwggaatagcataatttc

SEQ ID NO: 1125 - DNA, 33 bp, homo sapien
taaagcagtgtttcatraacttatttgaatctg

SEQ ID NO: 1126 - DNA, 33 bp, homo sapien
ttcatttgtaaaccgtrcgccttgaccagtgct

SEQ ID NO: 1127 - DNA, 33 bp, homo sapien
atacagaatccataagygattaagtggtatttt

SEQ ID NO: 1128 - DNA, 33 bp, homo sapien
tacttttgggagacctracaggttttgaaattc

SEQ ID NO: 1129 - DNA, 33 bp, homo sapien
acatttgtgactcaatmacatgaacaacatttt

SEQ ID NO: 1130 - DNA, 33 bp, homo sapien
aaatcatagaattcacrtaggattcatgaattc

SEQ ID NO: 1131 - DNA, 33 bp, homo sapien
gaagcaagtccaagttraatacatgttactgtt

SEQ ID NO: 1132 - DNA, 33 bp, homo sapien
taggctttgctgtttcmtttatagagcagagaa

SEQ ID NO: 1133 - DNA, 33 bp, homo sapien
aggaaatagacatcaascatttgagcacgttgg

SEQ ID NO: 1134 - DNA, 33 bp, homo sapien
aagtttaagtgaatgaygctaaagggtaatttc

SEQ ID NO: 1135 - DNA, 33 bp, homo sapien
tggaaagtaaattcacytgttcttagaagggta

SEQ ID NO: 1136 - DNA, 33 bp, homo sapien
attgatacagaaagagytttcaataaaatcaaa

SEQ ID NO: 1137 - DNA, 33 bp, homo sapien
gactgaaatggggacaraaatgcactctgagag

SEQ ID NO: 1138 - DNA, 33 bp, homo sapien
ataacaatgcagaaackacacaaagattcccat

SEQ ID NO: 1139 - DNA, 33 bp, homo sapien
gctggattctccacagygttcatcatcactaaa

SEQ ID NO: 1140 - DNA, 33 bp, homo sapien
gcataaaggcattctcrggtagcagcatggggt

SEQ ID NO: 1141 - DNA, 33 bp, homo sapien
caacaaaggagaagttytggctctgagatcaga

SEQ ID NO: 1142 - DNA, 33 bp, homo sapien
gtctaaaacaatgactyactcatgaaggataca

SEQ ID NO: 1143 - DNA, 33 bp, homo sapien
catccagttgcctaaaycacttatctgggaatc

SEQ ID NO: 1144 - DNA, 33 bp, homo sapien
aaagctccaacacactstaatgaatcttgttct

SEQ ID NO: 1145 - DNA, 33 bp, homo sapien
agagagaccatctgagyacaagtgatgggcgtg

SEQ ID NO: 1146 - DNA, 33 bp, homo sapien
gtgtggacaagaatacratacagtacttaggat

SEQ ID NO: 1147 - DNA, 33 bp, homo sapien
ctctcacatgacacagwttctaaacccttcata

SEQ ID NO: 1148 - DNA, 33 bp, homo sapien
gttcaggttccagcccrtgctgaggttcgaggg

SEQ ID NO: 1149 - DNA, 33 bp, homo sapien
acacagttggtccttaraagtgggctttagacc

SEQ ID NO: 1150 - DNA, 33 bp, homo sapien
ccctcagagcccagaayagcagaatataacaga

SEQ ID NO: 1151 - DNA, 33 bp, homo sapien
agaaaggaaatccagayacagacatgtgcacca

SEQ ID NO: 1152 - DNA, 33 bp, homo sapien
aacacatgactttaacyggtcgatctcaaaaaa

SEQ ID NO: 1153 - DNA, 33 bp, homo sapien
acgttaatctccagatyctgttaagccactaaa

SEQ ID NO: 1154 - DNA, 33 bp, homo sapien
tccctttatagtttcgyctactcttctttcccc

SEQ ID NO: 1155 - DNA, 33 bp, homo sapien
aagaactcacagtttcraagtgtttcaaaccat

SEQ ID NO: 1156 - DNA, 33 bp, homo sapien
acagaaatagataactrgataaacaaagtctca

SEQ ID NO: 1157 - DNA, 33 bp, homo sapien
tatgtaatgctacaggsatctagtgagtagagg

SEQ ID NO: 1158 - DNA, 33 bp, homo sapien
gtttcttacactttttwaatgaagtttcacaat

SEQ ID NO: 1159 - DNA, 33 bp, homo sapien
aggactcttacactatrctgtctcccgtgaggt

SEQ ID NO: 1160 - DNA, 33 bp, homo sapien
agtgttgaaaggaagaygagacacataaacctg

SEQ ID NO: 1161 - DNA, 33 bp, homo sapien
gggaatgtctcacggckaatcaaatgtcagttc

SEQ ID NO: 1162 - DNA, 33 bp, homo sapien
taagaatctgaagcaaygacagcaaagaccaaa

SEQ ID NO: 1163 - DNA, 33 bp, homo sapien
ccccactgcactgctgytttcctatgattggtt

SEQ ID NO: 1164 - DNA, 33 bp, homo sapien
atagcacaccatcctarattttttttcatctat

SEQ ID NO: 1165 - DNA, 33 bp, homo sapien
tagtaaggagtgttgarcctgcattccagactg

SEQ ID NO: 1166 - DNA, 33 bp, homo sapien
gactgaatagagagtgrtctgaacaactaagcc

SEQ ID NO: 1167 - DNA, 33 bp, homo sapien
gatactgtgctaagtcmtttctttgccatcaga

SEQ ID NO: 1168 - DNA, 33 bp, homo sapien
gtgggggtgtcataatktggtcctgatacactg

SEQ ID NO: 1169 - DNA, 33 bp, homo sapien
ccttcttcctacactayagtttggttccaaaat

SEQ ID NO: 1170 - DNA, 33 bp, homo sapien
taaattactgaaggaayggaatttgatcaggat

SEQ ID NO: 1171 - DNA, 33 bp, homo sapien
aaacttcttgcatgttwtatggcttttgctgcc

SEQ ID NO: 1172 - DNA, 33 bp, homo sapien
caagttacctctcagayatcaggcagatgatta

SEQ ID NO: 1173 - DNA, 33 bp, homo sapien
tacctacaaatgcctcygcataccagacaaaag

SEQ ID NO: 1174 - DNA, 33 bp, homo sapien
gtgctacgaggaggccrtgagaagaggctgaaa

SEQ ID NO: 1175 - DNA, 33 bp, homo sapien
tttttttcaatcagccrcaagctttcatatcac

SEQ ID NO: 1176 - DNA, 33 bp, homo sapien
ttgcctgtgaggacaayaatttgtttttttagg

SEQ ID NO: 1177 - DNA, 33 bp, homo sapien
ttgggctgagccaatcrgattgtctttcgcagg

SEQ ID NO: 1178 - DNA, 33 bp, homo sapien
gaagggcgtgcctcttratgcagtccagagagg

SEQ ID NO: 1179 - DNA, 33 bp, homo sapien
aacttaggatgcctgcrgttgtcaaggccatgg

SEQ ID NO: 1180 - DNA, 33 bp, homo sapien
tatatgtcagtagcacrtaagatcccatccctc

SEQ ID NO: 1181 - DNA, 33 bp, homo sapien
ctggagctgttcctatkaagccatgttggaacc

SEQ ID NO: 1182 - DNA, 33 bp, homo sapien
aagagcacaagggactrtttcttcaattactgc

SEQ ID NO: 1183 - DNA, 33 bp, homo sapien
acggagttagttatacygatcttcattttgacc

SEQ ID NO: 1184 - DNA, 33 bp, homo sapien
tattataagcagtgacytcaaagtgacagcctg

SEQ ID NO: 1185 - DNA, 33 bp, homo sapien
tatttcctttcctctckttctaatggcaaagta

SEQ ID NO: 1186 - DNA, 33 bp, homo sapien
tctcagcaatagatgakgacattttggactcag

SEQ ID NO: 1187 - DNA, 33 bp, homo sapien
caaaaatgtatcctaarataagccaacacataa

SEQ ID NO: 1188 - DNA, 33 bp, homo sapien
tgggtgagcaatttctkgcaggcatccagccca

SEQ ID NO: 1189 - DNA, 33 bp, homo sapien
acacatgacttttcagkatatattcttacccaa

SEQ ID NO: 1190 - DNA, 33 bp, homo sapien
accatggaacaatgttyaagattaaatacttga

SEQ ID NO: 1191 - DNA, 33 bp, homo sapien
acgcacatacatgcacrtccacaatccatgttc

SEQ ID NO: 1192 - DNA, 33 bp, homo sapien
aacccagagaatgctcraatagattttctatat

SEQ ID NO: 1193 - DNA, 33 bp, homo sapien
tctccaactgtaagctmttattatatggtcatc

SEQ ID NO: 1194 - DNA, 33 bp, homo sapien
aagaacatggagtgcaygtcatagccacttgcc

SEQ ID NO: 1195 - DNA, 33 bp, homo sapien
cagctgcttgaaggcarggatgatgcctatttc

SEQ ID NO: 1196 - DNA, 33 bp, homo sapien
atagaatatcgctattrttcaatgtggcaaaaa

SEQ ID NO: 1197 - DNA, 33 bp, homo sapien
gctatttattatcaacwatgataccactctgac

SEQ ID NO: 1198 - DNA, 33 bp, homo sapien
attcatacattccactscaaatattaatgtgtt

SEQ ID NO: 1199 - DNA, 33 bp, homo sapien
atggtggtgcattactkgaggtcccagctacgg

SEQ ID NO: 1200 - DNA, 33 bp, homo sapien
ataggtgacaaaagaawttcatagtgactatta

SEQ ID NO: 1201 - DNA, 33 bp, homo sapien
taggtgagcttcttcawcttgggcccccctccg

SEQ ID NO: 1202 - DNA, 33 bp, homo sapien
tttattgagaagagttwggaaataaagttactt

SEQ ID NO: 1203 - DNA, 33 bp, homo sapien
tcagggagctcattaaytcacaaggtagccctg

SEQ ID NO: 1204 - DNA, 33 bp, homo sapien
gagtcaccagactcttycttgggtgacagtgtc

SEQ ID NO: 1205 - DNA, 33 bp, homo sapien
tcaggtgaagttgattycagatgttcagcttta

SEQ ID NO: 1206 - DNA, 33 bp, homo sapien
tcggtgtttattgtccrtctcctctgccattcc

SEQ ID NO: 1207 - DNA, 33 bp, homo sapien
cattacatggggcctaygcctcagctcttagac

SEQ ID NO: 1208 - DNA, 33 bp, homo sapien
cacattgtcatttgatstttgtaaatatctcaa

SEQ ID NO: 1209 - DNA, 33 bp, homo sapien
tagcctggtatgtttarggaagagaaagatagt

SEQ ID NO: 1210 - DNA, 33 bp, homo sapien
gttcccctcatgcttcracacccttctccttct

SEQ ID NO: 1211 - DNA, 33 bp, homo sapien
agccccatgcaatgacyctgccttacatctcat

SEQ ID NO: 1212 - DNA, 33 bp, homo sapien
atgatcccgttggagargctacaaagaaatgct

SEQ ID NO: 1213 - DNA, 33 bp, homo sapien
ctctaaaagttgtctcrttctctccttattcct

SEQ ID NO: 1214 - DNA, 33 bp, homo sapien
tgcagggaagccaggcrtaagcagctatgtgct

SEQ ID NO: 1215 - DNA, 33 bp, homo sapien
tacagaaggtggagacrtatgtgtcaagagagt

SEQ ID NO: 1216 - DNA, 33 bp, homo sapien
aacatccctacgcagckatgttggctcccttat

SEQ ID NO: 1217 - DNA, 33 bp, homo sapien
aaggacttgtgtgattraagtgggctcacctgg

SEQ ID NO: 1218 - DNA, 33 bp, homo sapien
ttaaaaaggaatgcatrtacactatcaaatttt

SEQ ID NO: 1219 - DNA, 33 bp, homo sapien
acaggcatttatttctsaaagttctggagacag

SEQ ID NO: 1220 - DNA, 33 bp, homo sapien
tggctttgttctatcayccgtatctgctaagat

SEQ ID NO: 1221 - DNA, 33 bp, homo sapien
agattgttgtcagtctygtttggacatggtaat

SEQ ID NO: 1222 - DNA, 33 bp, homo sapien
aatcaaatttctatagscaagtagtaggaaaca

SEQ ID NO: 1223 - DNA, 33 bp, homo sapien
caaaatgatagctgcartagaaagtaaagctca

SEQ ID NO: 1224 - DNA, 33 bp, homo sapien
tgtcaacaatttcacaygtatgatctcatttca

SEQ ID NO: 1225 - DNA, 33 bp, homo sapien
gatacctgggacaatgmgggacaggtctgtgca

SEQ ID NO: 1226 - DNA, 33 bp, homo sapien
gatgagattagctgcayggctgaggagattgct

SEQ ID NO: 1227 - DNA, 33 bp, homo sapien
gtaagcttatatttcaktagtcaggtatgttta

SEQ ID NO: 1228 - DNA, 33 bp, homo sapien
gtgctcgattcctctaygtaaatcttcaccttt

SEQ ID NO: 1229 - DNA, 33 bp, homo sapien
tttgaagaaataggcawaaatttgttaagtgtg

SEQ ID NO: 1230 - DNA, 33 bp, homo sapien
agtcactgtcaagacckgagtttcagtgtagta

SEQ ID NO: 1231 - DNA, 33 bp, homo sapien
gcaataccatacaatcrgtagattttaaacaac

SEQ ID NO: 1232 - DNA, 33 bp, homo sapien
agatgaatccacacaargcaaagcattttcaca

SEQ ID NO: 1233 - DNA, 33 bp, homo sapien
ttcgaaatgggtctttygcgaagcccaatctta

SEQ ID NO: 1234 - DNA, 33 bp, homo sapien
tctatttcagtcactamtggggcttcatcccaa

SEQ ID NO: 1235 - DNA, 33 bp, homo sapien
aagcgatcttccctgtktcataagtaagctcat

SEQ ID NO: 1236 - DNA, 33 bp, homo sapien
ttgtgcccaagtgctcrctagtccagagactga

SEQ ID NO: 1237 - DNA, 33 bp, homo sapien
tgcctctcgcaaatccstgagtactctctcaga

SEQ ID NO: 1238 - DNA, 33 bp, homo sapien
atgaagtctcaaaattwatgttccagtcccagg

SEQ ID NO: 1239 - DNA, 33 bp, homo sapien
tgttctcacaggcatcwcagataggaagatgta

SEQ ID NO: 1240 - DNA, 33 bp, homo sapien
ggtttgctcgtctctgkttttgagtgtgtattc

SEQ ID NO: 1241 - DNA, 33 bp, homo sapien
atgtaaggaaattagartccctgtcctagttct

SEQ ID NO: 1242 - DNA, 33 bp, homo sapien
aagtgttatacccttasgcaatttaatagggcc

SEQ ID NO: 1243 - DNA, 33 bp, homo sapien
ctcagtggacaggagastttccatacaagagag

SEQ ID NO: 1244 - DNA, 33 bp, homo sapien
tgatttttagggtgtamttgtcacatcactgag

SEQ ID NO: 1245 - DNA, 33 bp, homo sapien
gagaaatgcttattgtwaattctaaagagaagg

SEQ ID NO: 1246 - DNA, 33 bp, homo sapien
acttccagctttctgtygggaaatcctcttaag

SEQ ID NO: 1247 - DNA, 33 bp, homo sapien
tcctgcaggtgccaatrggcagccgatatggga

SEQ ID NO: 1248 - DNA, 33 bp, homo sapien
tggttagttaattacaycctgttgcctccgaag

SEQ ID NO: 1249 - DNA, 33 bp, homo sapien
gggttctctaataatayacagagtggaaaaaac

SEQ ID NO: 1250 - DNA, 33 bp, homo sapien
ggtatatacctagaaawagaaccgctgcatcat

SEQ ID NO: 1251 - DNA, 33 bp, homo sapien
ttcacaacatgaaattsagtcaaggcagctggc

SEQ ID NO: 1252 - DNA, 33 bp, homo sapien
ggagcccaaatgccagrtgatgaatccatgacg

SEQ ID NO: 1253 - DNA, 33 bp, homo sapien
atccagacattaaaccragaaggaagtccagaa

SEQ ID NO: 1254 - DNA, 33 bp, homo sapien
ctgttttttcttctccygaatgcatttactgtg

SEQ ID NO: 1255 - DNA, 33 bp, homo sapien
agatattggataggtamcccacagtcacacacg

SEQ ID NO: 1256 - DNA, 33 bp, homo sapien
aagcaagcccatctctragtagaaaaatcaccc

SEQ ID NO: 1257 - DNA, 33 bp, homo sapien
ctgaaagtgggaagcaygtgagccaatgtttcc

SEQ ID NO: 1258 - DNA, 33 bp, homo sapien
cttataccacctcaaakgcctatttcaggacaa

SEQ ID NO: 1259 - DNA, 33 bp, homo sapien
gttgaaatcgtcctcartgaaaaaccttcctct

SEQ ID NO: 1260 - DNA, 33 bp, homo sapien
gaagtaggtactattawttatccactttataat

SEQ ID NO: 1261 - DNA, 33 bp, homo sapien
aacccttggcttatggycacatcattcccgtct

SEQ ID NO: 1262 - DNA, 33 bp, homo sapien
aaagaaatgaccatggytctttgatatctttga

SEQ ID NO: 1263 - DNA, 33 bp, homo sapien
aaatagtacttacagcrgttacacagtagttac

SEQ ID NO: 1264 - DNA, 33 bp, homo sapien
gggtaggtaattcaccrggtgttattctttcac

SEQ ID NO: 1265 - DNA, 33 bp, homo sapien
gatgttcaccataacaktgttgggcttcctggg

SEQ ID NO: 1266 - DNA, 33 bp, homo sapien
tggctcaccactgtcayttgtactcacacctga

SEQ ID NO: 1267 - DNA, 33 bp, homo sapien
tgccaagtcccttctgycatacatgtgaagtga

SEQ ID NO: 1268 - DNA, 33 bp, homo sapien
gttgaccattaggcttyatcctggttaccagtt

SEQ ID NO: 1269 - DNA, 33 bp, homo sapien
agatacagtgagcctgytcaaacatccagtaca

SEQ ID NO: 1270 - DNA, 33 bp, homo sapien
agatcaaacatttataytcaacttgcctgtttt

SEQ ID NO: 1271 - DNA, 33 bp, homo sapien
ctttgacaaaaagtaargcaagtgtgagcaaat

SEQ ID NO: 1272 - DNA, 33 bp, homo sapien
gaggtgttactggttgygtgttaactggtatgt

SEQ ID NO: 1273 - DNA, 33 bp, homo sapien
acacttttattcgggtrcttgttgctttacaga

SEQ ID NO: 1274 - DNA, 33 bp, homo sapien
accattaaataaagaamcaacgtaaaacaagag

SEQ ID NO: 1275 - DNA, 33 bp, homo sapien
ttctcagggcctttcayattatttttctttttt

SEQ ID NO: 1276 - DNA, 33 bp, homo sapien
caaagaacacatcgacracaggggagccccttg

SEQ ID NO: 1277 - DNA, 33 bp, homo sapien
atgttcagtatagacarccatccaatttcattt

SEQ ID NO: 1278 - DNA, 33 bp, homo sapien
gcaaaaagtcatagatytaaataaatggagaga

SEQ ID NO: 1279 - DNA, 33 bp, homo sapien
caaattcctgcttttcrtgcatcttggtggcct

SEQ ID NO: 1280 - DNA, 33 bp, homo sapien
cacaacgttttacgaaygtccagacttctccat

SEQ ID NO: 1281 - DNA, 33 bp, homo sapien
ttatgagacactcttastaccatactcaaaata

SEQ ID NO: 1282 - DNA, 33 bp, homo sapien
ccttaatgcttcctatstctcacacagcctata

SEQ ID NO: 1283 - DNA, 33 bp, homo sapien
ctggagatttataactygtaatgaatgttaagc

SEQ ID NO: 1284 - DNA, 33 bp, homo sapien
agaagtctgaaatcaakgtgtaaagagggccct

SEQ ID NO: 1285 - DNA, 33 bp, homo sapien
cgatacacctattttasaggtggctgaataaca

SEQ ID NO: 1286 - DNA, 33 bp, homo sapien
cactgccccctactagygttactgtgtccacat

SEQ ID NO: 1287 - DNA, 33 bp, homo sapien
ttgtagcacattgtgartcctccataaatggtt

SEQ ID NO: 1288 - DNA, 33 bp, homo sapien
tgtagatcattaactcrggtctgactcacatta

SEQ ID NO: 1289 - DNA, 33 bp, homo sapien
tcatgatgtttctggtrtagggaagagtttgga

SEQ ID NO: 1290 - DNA, 33 bp, homo sapien
gtcgggagcttctcccrcaaagactttcagctt

SEQ ID NO: 1291 - DNA, 33 bp, homo sapien
gtttccttcctgtacakactggaccaaaacagc

SEQ ID NO: 1292 - DNA, 33 bp, homo sapien
catgattaaagggaccygcagtcatgttcattg

SEQ ID NO: 1293 - DNA, 33 bp, homo sapien
gggagtggcttgaattrgatggtgatatctgga

SEQ ID NO: 1294 - DNA, 33 bp, homo sapien
tcactagaccccaggtsatcagctgcactagac

SEQ ID NO: 1295 - DNA, 33 bp, homo sapien
ggagggaaaaagccagsgatggtgcaacacccc

SEQ ID NO: 1296 - DNA, 33 bp, homo sapien
ctttgcaacctccaacygctggattcaaacaat

SEQ ID NO: 1297 - DNA, 33 bp, homo sapien
taagcatgacaattacyacactataaactacac

SEQ ID NO: 1298 - DNA, 33 bp, homo sapien
aaatatgaacagcttamcaaagatcagtaagca

SEQ ID NO: 1299 - DNA, 33 bp, homo sapien
catcatggtgatcctayaagattataatgaagc

SEQ ID NO: 1300 - DNA, 33 bp, homo sapien
gttgtagtcactgagcygcagcaggcgctcgaa

SEQ ID NO: 1301 - DNA, 33 bp, homo sapien
catcacatatgtgaccygtttagtgtcaactca

SEQ ID NO: 1302 - DNA, 33 bp, homo sapien
ctcatttacttgggttycgctcagcaacaaaga

SEQ ID NO: 1303 - DNA, 33 bp, homo sapien
gagtcagatagtccagsgttaaatgcctcctct

SEQ ID NO: 1304 - DNA, 33 bp, homo sapien
agtccagcccatcataytgtaggaatgtctccc

SEQ ID NO: 1305 - DNA, 33 bp, homo sapien
gctgctgacagaggctyctctctactcaggctg

SEQ ID NO: 1306 - DNA, 33 bp, homo sapien
ttctgagaacaaacacmagtacaactaattgct

SEQ ID NO: 1307 - DNA, 33 bp, homo sapien
aacctcaaccaattctrtgaaaacaagcgatcc

SEQ ID NO: 1308 - DNA, 33 bp, homo sapien
tcattgcatctcaattwtccaggcatggtccgg

SEQ ID NO: 1309 - DNA, 33 bp, homo sapien
tgcctcccttaactccyagcataatctctgcaa

SEQ ID NO: 1310 - DNA, 33 bp, homo sapien
gtgtgtctgaaattaaygggacatggaggctta

SEQ ID NO: 1311 - DNA, 33 bp, homo sapien
aataccaaacaaaagaygacacaacccaaaagt

SEQ ID NO: 1312 - DNA, 33 bp, homo sapien
gttgccaatccagaaarcttgctaaaagtgagt

SEQ ID NO: 1313 - DNA, 33 bp, homo sapien
cactttatacctactgmcctggcgtctcaccgg

SEQ ID NO: 1314 - DNA, 33 bp, homo sapien
agaagcgcacctcagtrttatgtgtatgaagtt

SEQ ID NO: 1315 - DNA, 33 bp, homo sapien
atctgtctagtgaatgrgctgagaggtgagtga

SEQ ID NO: 1316 - DNA, 33 bp, homo sapien
ccttggcttctgatatrgcataataccaagaag

SEQ ID NO: 1317 - DNA, 33 bp, homo sapien
tcatgagagaagacacrctctttggatagtatg

SEQ ID NO: 1318 - DNA, 33 bp, homo sapien
cgtgtgtggatcatgcktgtcatattgatcagc

SEQ ID NO: 1319 - DNA, 33 bp, homo sapien
caatgaaacaccacagmtgccagagccttaatc

SEQ ID NO: 1320 - DNA, 33 bp, homo sapien
ggcattgtgctaggtgycctggaggaatacaaa

SEQ ID NO: 1321 - DNA, 33 bp, homo sapien
tgtgtcgccctttaccragcaagccaacctcag

SEQ ID NO: 1322 - DNA, 33 bp, homo sapien
cccccatttccatttgytctgccattcaaaacc

SEQ ID NO: 1323 - DNA, 33 bp, homo sapien
tctcattttagaatacytcatgagattgaaaaa

SEQ ID NO: 1324 - DNA, 33 bp, homo sapien
ctcaaaccttttcttcmgacgtagaatgccaga

SEQ ID NO: 1325 - DNA, 33 bp, homo sapien
taaaatgaataatgaayggcagacttaaaaatt

SEQ ID NO: 1326 - DNA, 33 bp, homo sapien
tgttgctaaagatttcycaattttactggactt

SEQ ID NO: 1327 - DNA, 33 bp, homo sapien
tcaacaaggctcaattstgcttttccctcatat

SEQ ID NO: 1328 - DNA, 33 bp, homo sapien
atatatatttcttttgycaacctgcatctttaa

SEQ ID NO: 1329 - DNA, 33 bp, homo sapien
tcaaactaacgcagccrtaactggtatggatgc

SEQ ID NO: 1330 - DNA, 33 bp, homo sapien
tccttctgaccactatytcttgccacttcagtg

SEQ ID NO: 1331 - DNA, 33 bp, homo sapien
actaatacaacaagcartctatcctacaattct

SEQ ID NO: 1332 - DNA, 33 bp, homo sapien
gaagttgtgcacatgcycatctgtggcattttt

SEQ ID NO: 1333 - DNA, 33 bp, homo sapien
ttcgtgtgatgttccartgaaaacagacataca

SEQ ID NO: 1334 - DNA, 33 bp, homo sapien
gaaggaaacagggcttyctttatggacaccttt

SEQ ID NO: 1335 - DNA, 33 bp, homo sapien
ataaatgtcaatttccrtttttctactatgcat

SEQ ID NO: 1336 - DNA, 33 bp, homo sapien
attctttcttctgctgratcaattctattctat

SEQ ID NO: 1337 - DNA, 33 bp, homo sapien
tccaaatagcagaaacrgagactcctggtttgg

SEQ ID NO: 1338 - DNA, 33 bp, homo sapien
tttttactataggcatyagaaatgtgagaaatg

SEQ ID NO: 1339 - DNA, 33 bp, homo sapien
actactttttataaatkttgaacacgatcatct

SEQ ID NO: 1340 - DNA, 33 bp, homo sapien
gaatatgggaagaaagrtttggtttctaaaata

SEQ ID NO: 1341 - DNA, 33 bp, homo sapien
gaaactgacgttagtawtaggccttaaacagat

SEQ ID NO: 1342 - DNA, 33 bp, homo sapien
tttctcatcttgcaaawaatgaaactctttatc

SEQ ID NO: 1343 - DNA, 33 bp, homo sapien
taggtggactggccttrgctggccgaatcttca

SEQ ID NO: 1344 - DNA, 33 bp, homo sapien
agctcagcttcctaccrctatggtccagatcct

SEQ ID NO: 1345 - DNA, 33 bp, homo sapien
ttggtctggataaggtmactgccataacaaaaa

SEQ ID NO: 1346 - DNA, 33 bp, homo sapien
gagggtcttgaatctcrtgtaggaagaaattca

SEQ ID NO: 1347 - DNA, 33 bp, homo sapien
ctagagtctgaactgtraaagaaattgtgctgc

SEQ ID NO: 1348 - DNA, 33 bp, homo sapien
gttcttgaccttggctrtctctgtctactcctc

SEQ ID NO: 1349 - DNA, 33 bp, homo sapien
aactctgaagatttttrtggcaattccaagaga

SEQ ID NO: 1350 - DNA, 33 bp, homo sapien
cttaagtgatgaggacytagatttgaccccagt

SEQ ID NO: 1351 - DNA, 33 bp, homo sapien
tgcctaaattattctgyatcttgcattccctga

SEQ ID NO: 1352 - DNA, 33 bp, homo sapien
gcatggcattctgagcrggtatacaagaaacca

SEQ ID NO: 1353 - DNA, 33 bp, homo sapien
attgagcatctatactrtgtcaggtgccatgct

SEQ ID NO: 1354 - DNA, 33 bp, homo sapien
ctttccagtgtactacyaccaacaattcgtcaa

SEQ ID NO: 1355 - DNA, 33 bp, homo sapien
gtcaacagtcccaaaakaaatgttgcctgttgc

SEQ ID NO: 1356 - DNA, 33 bp, homo sapien
atcatccacctctttgwtatagacccaggggag

SEQ ID NO: 1357 - DNA, 33 bp, homo sapien
tagtgggaccaagtagrtctagctttgtatcta

SEQ ID NO: 1358 - DNA, 33 bp, homo sapien
ggggtagtgcaaccaayaatgtttttgtaaaca

SEQ ID NO: 1359 - DNA, 33 bp, homo sapien
tgtcctgctttacctgmttctcaaatgacagaa

SEQ ID NO: 1360 - DNA, 33 bp, homo sapien
ctcaacaaaatgctacraaacttaatccaacaa

SEQ ID NO: 1361 - DNA, 33 bp, homo sapien
caaaaaagaagtatcarggtatatatgaagaga

SEQ ID NO: 1362 - DNA, 33 bp, homo sapien
ggtaagtcgaactgttwcctttccagaaaagac

SEQ ID NO: 1363 - DNA, 33 bp, homo sapien
tagctcagaagagtaaygataactgttcttatc

SEQ ID NO: 1364 - DNA, 33 bp, homo sapien
catgtttttttgtctcrtggttacattatggct

SEQ ID NO: 1365 - DNA, 33 bp, homo sapien
acagagctcgtaagtgytcaaattcagattgga

SEQ ID NO: 1366 - DNA, 33 bp, homo sapien
ccactgctcttaaagcycttatttctcagtggc

SEQ ID NO: 1367 - DNA, 33 bp, homo sapien
caaaatcagagtagagyaagtagcagttttaca

SEQ ID NO: 1368 - DNA, 33 bp, homo sapien
tataaaaacaaatgtaygtatgaggcacataac

SEQ ID NO: 1369 - DNA, 33 bp, homo sapien
gggcaaccatgatgttygtgttgcaatttgtac

SEQ ID NO: 1370 - DNA, 33 bp, homo sapien
gtcacaaacacttatgycagctcttgaggcagg

SEQ ID NO: 1371 - DNA, 33 bp, homo sapien
agttcttggatataacrcatttgtaataccata

SEQ ID NO: 1372 - DNA, 33 bp, homo sapien
agaattaagattcagaratgtacagatagaggg

SEQ ID NO: 1373 - DNA, 33 bp, homo sapien
ctacaaatcacattatrtacatgacacattcct

SEQ ID NO: 1374 - DNA, 33 bp, homo sapien
acaggtagcagggattrggatgtgaacgcagct

SEQ ID NO: 1375 - DNA, 33 bp, homo sapien
ttcttttaaaaaatgamgagtctgtcaaaacct

SEQ ID NO: 1376 - DNA, 33 bp, homo sapien
taagtctttcttactaycattcctctctgaaat

SEQ ID NO: 1377 - DNA, 33 bp, homo sapien
ttcacacaacttcctcyggaaacacttgtgaat

SEQ ID NO: 1378 - DNA, 33 bp, homo sapien
tctcatctccacaattkttgctttaggaattcc

SEQ ID NO: 1379 - DNA, 33 bp, homo sapien
tgacctcttctattcaygcacttcaggaacagc

SEQ ID NO: 1380 - DNA, 33 bp, homo sapien
atgaattcccgaattcygctgtctggtctcaaa

SEQ ID NO: 1381 - DNA, 33 bp, homo sapien
cctagactttttcagcraaaccctaagactcct

SEQ ID NO: 1382 - DNA, 33 bp, homo sapien
cagcaagtctatgagayggactaacacccatgg

SEQ ID NO: 1383 - DNA, 33 bp, homo sapien
ctttgaccttttggaayacaaacccattcatct

SEQ ID NO: 1384 - DNA, 33 bp, homo sapien
ttaagagcttaacatgstgtatggtgcttagca

SEQ ID NO: 1385 - DNA, 33 bp, homo sapien
ctgaaggcagtgtcacrgcacaaagaaactagc

SEQ ID NO: 1386 - DNA, 33 bp, homo sapien
gtactaaaccaatcttrttgttgtgaaattaac

SEQ ID NO: 1387 - DNA, 33 bp, homo sapien
aacatgagatggaaatmatgccaaggctgtcac

SEQ ID NO: 1388 - DNA, 33 bp, homo sapien
agctattttctggaggycttttctggaaacgat

SEQ ID NO: 1389 - DNA, 33 bp, homo sapien
aaaacagaactaaattmtgattatatctgtctg

SEQ ID NO: 1390 - DNA, 33 bp, homo sapien
actctgaagtaacagtyacaacagcattttaca

SEQ ID NO: 1391 - DNA, 33 bp, homo sapien
tatgaaaaaaatatcasacaaattccaattggg

SEQ ID NO: 1392 - DNA, 33 bp, homo sapien
cacgtatgggccctttygtcacctggacttctc

SEQ ID NO: 1393 - DNA, 33 bp, homo sapien
tgaatccttgaactctktgtctgaaagtcaaca

SEQ ID NO: 1394 - DNA, 33 bp, homo sapien
aacccgtttctctagckctttatttgtgtgatt

SEQ ID NO: 1395 - DNA, 33 bp, homo sapien
tccagatatgatttcakttgggccagttagatg

SEQ ID NO: 1396 - DNA, 33 bp, homo sapien
ctcttctaaagcatgcrtacactcacaaaaccc

SEQ ID NO: 1397 - DNA, 33 bp, homo sapien
ggggttgccaataggaragtggaattcctgagc

SEQ ID NO: 1398 - DNA, 33 bp, homo sapien
gtgtaatgtgggaagaktctcacttgttaatta

SEQ ID NO: 1399 - DNA, 33 bp, homo sapien
atgcacctgaagaactktttcaccttcccaaac

SEQ ID NO: 1400 - DNA, 33 bp, homo sapien
agaggaaattttgcagkcatactggaggaaacc

SEQ ID NO: 1401 - DNA, 33 bp, homo sapien
cccagccatggtggttrcggtgaaagactcctt

SEQ ID NO: 1402 - DNA, 33 bp, homo sapien
actgtttcgggcattayacttattatccacatg

SEQ ID NO: 1403 - DNA, 33 bp, homo sapien
ccacaggaaggctgaaytggatgctcaccaaga

SEQ ID NO: 1404 - DNA, 33 bp, homo sapien
tttgccaaaagcctacrtgtgctgttatggcct

SEQ ID NO: 1405 - DNA, 33 bp, homo sapien
ttttgccagtatgttaygggcttcatcagagaa

SEQ ID NO: 1406 - DNA, 33 bp, homo sapien
tgacctggaagcgctcrtgcagccagaccctga

SEQ ID NO: 1407 - DNA, 33 bp, homo sapien
aaatgggaagacaagtmggactgaaatcaatgg

SEQ ID NO: 1408 - DNA, 33 bp, homo sapien
ttacattccataacatyttaatggttgggctgg

SEQ ID NO: 1409 - DNA, 33 bp, homo sapien
ggtggcccaaggaccartcagtgtgcactttct

SEQ ID NO: 1410 - DNA, 33 bp, homo sapien
tgtctcattaaactttkgtcagttatgtcctat

SEQ ID NO: 1411 - DNA, 33 bp, homo sapien
gtgggatttcttttaarcattggttctccttag

SEQ ID NO: 1412 - DNA, 33 bp, homo sapien
taaaatgtacagtttartgggttatgttatatt

SEQ ID NO: 1413 - DNA, 33 bp, homo sapien
ctcttgggttcatgacmgtggctagaggtgatg

SEQ ID NO: 1414 - DNA, 33 bp, homo sapien
gagttttatactcttgyggttttgtgaatctag

SEQ ID NO: 1415 - DNA, 33 bp, homo sapien
atttttatgttagaccrttctggcagcaatgtg

SEQ ID NO: 1416 - DNA, 33 bp, homo sapien
ccatcccattaactgtkgatgttgtcatcagtg

SEQ ID NO: 1417 - DNA, 33 bp, homo sapien
ggaaagcaaaaaaccaygttttccagacttgct

SEQ ID NO: 1418 - DNA, 33 bp, homo sapien
ttttgattattcattarcttcatctttttatat

SEQ ID NO: 1419 - DNA, 33 bp, homo sapien
gaatgtgaggatcattmactgtccagaaatcta

SEQ ID NO: 1420 - DNA, 33 bp, homo sapien
cttctcattctggcagygccccctgctatgttt

SEQ ID NO: 1421 - DNA, 33 bp, homo sapien
ctggtggcacttacttyagtgtctgagctttaa

SEQ ID NO: 1422 - DNA, 33 bp, homo sapien
cctgcctggattgtgcytctgactccctgagca

SEQ ID NO: 1423 - DNA, 33 bp, homo sapien
gctgtgtagcgcttccygctttgttctctctct

SEQ ID NO: 1424 - DNA, 33 bp, homo sapien
ttcattcattccaggarcttctactgagcagtt

SEQ ID NO: 1425 - DNA, 33 bp, homo sapien
acatcactgcacttgcwtgagggacttggagcc

SEQ ID NO: 1426 - DNA, 33 bp, homo sapien
tggcatgggcaaatttratgtaagagggcaaaa

SEQ ID NO: 1427 - DNA, 33 bp, homo sapien
aaacgccaatgccaaamatatgctctcaaaggg

SEQ ID NO: 1428 - DNA, 33 bp, homo sapien
tttagacgcatcactcstatatctgcctccgcc

SEQ ID NO: 1429 - DNA, 33 bp, homo sapien
tccaatttcagaggaawatctgaactgtcctga

SEQ ID NO: 1430 - DNA, 33 bp, homo sapien
atgaatagagtctcccrtgcatgcaggccctga

SEQ ID NO: 1431 - DNA, 33 bp, homo sapien
actccctacgatgggaytctctcaactgtccct

SEQ ID NO: 1432 - DNA, 33 bp, homo sapien
gttctttgtcctatacstgtgaagatgagctat

SEQ ID NO: 1433 - DNA, 33 bp, homo sapien
gtaccaggctgccctgyttgtgccttagtggga

SEQ ID NO: 1434 - DNA, 33 bp, homo sapien
aattgattaagattttkcttctcatctcaaacc

SEQ ID NO: 1435 - DNA, 33 bp, homo sapien
ctgctaagtgtccaacrtgcattctctcattgt

SEQ ID NO: 1436 - DNA, 33 bp, homo sapien
tcacttgactctatatygaatgcacagacttgg

SEQ ID NO: 1437 - DNA, 33 bp, homo sapien
attcctactggaaaaaytgtgtccagatgttgt

SEQ ID NO: 1438 - DNA, 33 bp, homo sapien
ggctattctcaggcagraggcacgacgattgta

SEQ ID NO: 1439 - DNA, 33 bp, homo sapien
tgatctgtttgacttgytgatgattccatagga

SEQ ID NO: 1440 - DNA, 33 bp, homo sapien
ttaaaggatcttggccrtattctgagccaccta

SEQ ID NO: 1441 - DNA, 33 bp, homo sapien
tttaattatcctcaacrttactgccatacccta

SEQ ID NO: 1442 - DNA, 33 bp, homo sapien
agatatgagccctttcyggtaaaaagcaagtgg

SEQ ID NO: 1443 - DNA, 33 bp, homo sapien
gtgaatgtttccctcgrgcccttggatattttt

SEQ ID NO: 1444 - DNA, 33 bp, homo sapien
gctagtgctactttctyaccttgtgtttctaac

SEQ ID NO: 1445 - DNA, 33 bp, homo sapien
ttagccattggaaaaayagaaattaaaactaca

SEQ ID NO: 1446 - DNA, 33 bp, homo sapien
gacaggaagagaaagcrtaggacaaggcccatt

SEQ ID NO: 1447 - DNA, 33 bp, homo sapien
tccataacacaaatagmcctcaggaggaatcgt

SEQ ID NO: 1448 - DNA, 33 bp, homo sapien
tgtacctgaagtgaaakattaatgtcccagact

SEQ ID NO: 1449 - DNA, 33 bp, homo sapien
agtgactaaaatgatgkcaaataaggcaatata

SEQ ID NO: 1450 - DNA, 33 bp, homo sapien
ggcagctgtctatatcygataggctacagttct

SEQ ID NO: 1451 - DNA, 33 bp, homo sapien
ttagttcaagcaagagktgagagctggttgttg

SEQ ID NO: 1452 - DNA, 33 bp, homo sapien
gaaaagctgatgtggawagaaccactggctccc

SEQ ID NO: 1453 - DNA, 33 bp, homo sapien
aagtacactgtaataasgtcactaaagctgtaa

SEQ ID NO: 1454 - DNA, 33 bp, homo sapien
atacatcaatacaacayccagcttcatttttag

SEQ ID NO: 1455 - DNA, 33 bp, homo sapien
gagtcaggcaactataytattatgccaaatagt

SEQ ID NO: 1456 - DNA, 33 bp, homo sapien
aagcactaacctttctkattccctttctcactc

SEQ ID NO: 1457 - DNA, 33 bp, homo sapien
atacttgtacgctaggmattttctcatggacct

SEQ ID NO: 1458 - DNA, 33 bp, homo sapien
tgcttcaggcattaatygaaagtttgaaagtgt

SEQ ID NO: 1459 - DNA, 33 bp, homo sapien
tgaatttgttcttagartaaatgacaataaaga

SEQ ID NO: 1460 - DNA, 33 bp, homo sapien
ctgtttattccagcccrtgatgttggagagaca

SEQ ID NO: 1461 - DNA, 33 bp, homo sapien
tttccaaaagaaaatgscttcagtaccacaaaa

SEQ ID NO: 1462 - DNA, 33 bp, homo sapien
cataaaaacatctataygaacaacaaaaatata

SEQ ID NO: 1463 - DNA, 33 bp, homo sapien
gaaggagttggcttacrtgattgtgaggtctag

SEQ ID NO: 1464 - DNA, 33 bp, homo sapien
tagaagttgccatatcyatttctgtgatgctaa

SEQ ID NO: 1465 - DNA, 33 bp, homo sapien
aaataaaatgacactckggtgattacaaatggt

SEQ ID NO: 1466 - DNA, 33 bp, homo sapien
atcattacggtatagtktaccgtggactcagct

SEQ ID NO: 1467 - DNA, 33 bp, homo sapien
caaactgaggttaaacrgccagcaaggggcagg

SEQ ID NO: 1468 - DNA, 33 bp, homo sapien
ctaaaataggatttgartgtaagcattaataag

SEQ ID NO: 1469 - DNA, 33 bp, homo sapien
gcttatgttgtagcttkaaatctcttatgatga

SEQ ID NO: 1470 - DNA, 33 bp, homo sapien
gtagcctcaggaaaatrggaagaagaaatggag

SEQ ID NO: 1471 - DNA, 33 bp, homo sapien
gcaaacacacactgaawctaagtaatacttttc

SEQ ID NO: 1472 - DNA, 33 bp, homo sapien
ataaatccaagttttaygagatgacaaaattag

SEQ ID NO: 1473 - DNA, 33 bp, homo sapien
aatagcaaaaatgtccrggtataggagaggaca

SEQ ID NO: 1474 - DNA, 33 bp, homo sapien
tgcttttcctagagccygtgagccgggaaaaaa

SEQ ID NO: 1475 - DNA, 33 bp, homo sapien
tcaaaacagtgtacaayatttccctttctaata

SEQ ID NO: 1476 - DNA, 33 bp, homo sapien
tgtttgaggctgcaaayttctgcaatgtagggg

SEQ ID NO: 1477 - DNA, 33 bp, homo sapien
acagatcaatatccctrcatggaactcttggaa

SEQ ID NO: 1478 - DNA, 33 bp, homo sapien
tggttgtgcacaataartaattgaattatcctc

SEQ ID NO: 1479 - DNA, 33 bp, homo sapien
agggtgatgttatgaaytgcctttctaaaattt

SEQ ID NO: 1480 - DNA, 33 bp, homo sapien
tatagttcactcactcygaaacatgctggaggg

SEQ ID NO: 1481 - DNA, 33 bp, homo sapien
tgacttaactctgagtktgaacgaaaagtacaa

SEQ ID NO: 1482 - DNA, 33 bp, homo sapien
gagacaccaaagagcakatagaaataggtgaga

SEQ ID NO: 1483 - DNA, 33 bp, homo sapien
aacagatactttgacaraagtgccacaatggac

SEQ ID NO: 1484 - DNA, 33 bp, homo sapien
atttatccaaatgtcartaatcagttggaaatt

SEQ ID NO: 1485 - DNA, 33 bp, homo sapien
gctaataggctctgatrtagctctcaccaaaga

SEQ ID NO: 1486 - DNA, 33 bp, homo sapien
aaattgtgtaatagcayccctagcatatcttga

SEQ ID NO: 1487 - DNA, 33 bp, homo sapien
tttctagtaactctctraagtctctggagaacc

SEQ ID NO: 1488 - DNA, 33 bp, homo sapien
caggatcaggctcaggwtgaaatcgagtctccc

SEQ ID NO: 1489 - DNA, 33 bp, homo sapien
cagctaactttattgtrtacaaactcataatgt

SEQ ID NO: 1490 - DNA, 33 bp, homo sapien
cacccccaaggcaagawctgatatgatttcctc

SEQ ID NO: 1491 - DNA, 33 bp, homo sapien
cataccagtatttctgsacgaaggatttaaaat

SEQ ID NO: 1492 - DNA, 33 bp, homo sapien
acttgctcttgcctcaytcgacctccaaagtgg

SEQ ID NO: 1493 - DNA, 33 bp, homo sapien
cctaataatgtatcacyctgaattgctattttt

SEQ ID NO: 1494 - DNA, 33 bp, homo sapien
gcacaacttgaggactktaagtaacacaattgt

SEQ ID NO: 1495 - DNA, 33 bp, homo sapien
tgttttcttgccttgakatatgaggctgtaccg

SEQ ID NO: 1496 - DNA, 33 bp, homo sapien
gccctcttgagtctatycttgtctctgtaatga

SEQ ID NO: 1497 - DNA, 33 bp, homo sapien
atcacagaattagcagktggcagaccccagttt

SEQ ID NO: 1498 - DNA, 33 bp, homo sapien
ggccaaaaagaggtacygagatttcctcaccaa

SEQ ID NO: 1499 - DNA, 33 bp, homo sapien
cctcattgaagttattmctgtttcttgtaagag

SEQ ID NO: 1500 - DNA, 33 bp, homo sapien
tcttttcttctcacatkgaaggagacttttctc

SEQ ID NO: 1501 - DNA, 33 bp, homo sapien
agtctgtggaaaacagrgattgtatcttatgta

SEQ ID NO: 1502 - DNA, 33 bp, homo sapien
aactacttggcaagaaygttacaaatgaaatca

SEQ ID NO: 1503 - DNA, 33 bp, homo sapien
agtggtaattcaatgcrtaacatattttcaaat

SEQ ID NO: 1504 - DNA, 33 bp, homo sapien
tcagtattaatattacrtaacatgaggtcaaag

SEQ ID NO: 1505 - DNA, 33 bp, homo sapien
attagaaattaactctycttgcttatctttcca

SEQ ID NO: 1506 - DNA, 33 bp, homo sapien
gaagcttatgactttgkgttccttattaatgtc

SEQ ID NO: 1507 - DNA, 33 bp, homo sapien
ctatactgttccattcytgttacacttgggagt

SEQ ID NO: 1508 - DNA, 33 bp, homo sapien
cattcttaccaacagcyctcagtgaaccctgcc

SEQ ID NO: 1509 - DNA, 33 bp, homo sapien
tctaaataaatgtctgygattaggttattcatt

SEQ ID NO: 1510 - DNA, 33 bp, homo sapien
gttgtgaataggaaggkctctctgtgatctggc

SEQ ID NO: 1511 - DNA, 33 bp, homo sapien
aaacagctcatggtacyattgcaatcaaactct

SEQ ID NO: 1512 - DNA, 33 bp, homo sapien
gggtgcagacgtgtgtrggagcataaatgggga

SEQ ID NO: 1513 - DNA, 33 bp, homo sapien
tgtgaacaaaattaacyctgtgtgtattgagga

SEQ ID NO: 1514 - DNA, 33 bp, homo sapien
caatttgcttagaagcktaaggtttatccatag

SEQ ID NO: 1515 - DNA, 33 bp, homo sapien
cacccctcttttcctayttcctctaagtagtgg

SEQ ID NO: 1516 - DNA, 33 bp, homo sapien
aaaatttaccagaaaamctgttgctattaataa

SEQ ID NO: 1517 - DNA, 33 bp, homo sapien
aagaaacaaggaaggcrtgagagacagcgaaga

SEQ ID NO: 1518 - DNA, 33 bp, homo sapien
tggaagatacccactgraatttgagaccctaga

SEQ ID NO: 1519 - DNA, 33 bp, homo sapien
ccctaatgagtctaagstgaatctagttatttt

SEQ ID NO: 1520 - DNA, 33 bp, homo sapien
tcatttaaagaaattgraaataaacactctcac

SEQ ID NO: 1521 - DNA, 33 bp, homo sapien
cgaaaccctggagtatygcaatcatgacttctc

SEQ ID NO: 1522 - DNA, 33 bp, homo sapien
atagctgccacatactrggagcttgctctatgc

SEQ ID NO: 1523 - DNA, 33 bp, homo sapien
atattgttttccacaayggtatttggctacact

SEQ ID NO: 1524 - DNA, 33 bp, homo sapien
agaggctgtctctactmtgtacatggagcgtga

SEQ ID NO: 1525 - DNA, 33 bp, homo sapien
ctttcttcttcttaccrtcctatgtacagcttc

SEQ ID NO: 1526 - DNA, 33 bp, homo sapien
tgataagattcagcagycctggaaagttattat

SEQ ID NO: 1527 - DNA, 33 bp, homo sapien
agatgaggcctttttgytctctgcatcccagat

SEQ ID NO: 1528 - DNA, 33 bp, homo sapien
tagtgtgtacgtgactrtatcttgtatagaaat

SEQ ID NO: 1529 - DNA, 33 bp, homo sapien
cataaacctatgctcarttccaagcctcactac

SEQ ID NO: 1530 - DNA, 33 bp, homo sapien
tttgtgtaatacttccratatcatattcattgt

SEQ ID NO: 1531 - DNA, 33 bp, homo sapien
tcagtgcatcttacttyatgagaaatgcatgct

SEQ ID NO: 1532 - DNA, 33 bp, homo sapien
tcccactcctatgtctrtatctaagagaaagaa

SEQ ID NO: 1533 - DNA, 33 bp, homo sapien
gcagccacagtttacaygagcacagagttcaaa

SEQ ID NO: 1534 - DNA, 33 bp, homo sapien
gagttaaattttgtatrtggtaaaccttttgct

SEQ ID NO: 1535 - DNA, 33 bp, homo sapien
tctaaagtctgcataamtgtgggatgcctccac

SEQ ID NO: 1536 - DNA, 33 bp, homo sapien
aatttcttattgactastagctagaaatatgtg

SEQ ID NO: 1537 - DNA, 33 bp, homo sapien
tggtgtcctactgtgamgattttgccttttaat

SEQ ID NO: 1538 - DNA, 33 bp, homo sapien
ttggcacatggatgaawgattgcagtaaccgtg

SEQ ID NO: 1539 - DNA, 33 bp, homo sapien
tcagttgtgattcacakatttaatcccaggtag

SEQ ID NO: 1540 - DNA, 33 bp, homo sapien
atgactgtgttttaggygataacatttcataga

SEQ ID NO: 1541 - DNA, 33 bp, homo sapien
cataaacctgtgtacasaaaaagttgaaaataa

SEQ ID NO: 1542 - DNA, 33 bp, homo sapien
acccacagaagtgaccrgacccaggagtctctc

SEQ ID NO: 1543 - DNA, 33 bp, homo sapien
tacagggctataagagmataaattcatgttgta

SEQ ID NO: 1544 - DNA, 33 bp, homo sapien
atgtgcattttccttaygttgctaatacaaggc

SEQ ID NO: 1545 - DNA, 33 bp, homo sapien
gcaggtgctgaccaagracaggttaaacctagt

SEQ ID NO: 1546 - DNA, 33 bp, homo sapien
atttattcctatggctycaaaggtcttaataat

SEQ ID NO: 1547 - DNA, 33 bp, homo sapien
tattgcattaaagttaytggtgctttaagactt

SEQ ID NO: 1548 - DNA, 33 bp, homo sapien
acaaaccttcacacaartctaaattttattact

SEQ ID NO: 1549 - DNA, 33 bp, homo sapien
agagctcagatgtttgyacctttctttaaatgg

SEQ ID NO: 1550 - DNA, 33 bp, homo sapien
gtaaaaatggctacaaycagaacgattaacagg

SEQ ID NO: 1551 - DNA, 33 bp, homo sapien
gcagctataaatatacytttcagagtgaggaga

SEQ ID NO: 1552 - DNA, 33 bp, homo sapien
cttcagtaatgtccttyatagtgaaaagatcca

SEQ ID NO: 1553 - DNA, 33 bp, homo sapien
tcaccttgttgtgagaycagacaaagatttaga

SEQ ID NO: 1554 - DNA, 33 bp, homo sapien
gagtgacacatcctgartaaggctataaggatt

SEQ ID NO: 1555 - DNA, 33 bp, homo sapien
gaaaaatattaatcacractagtttcagaaaca

SEQ ID NO: 1556 - DNA, 33 bp, homo sapien
cctggtgtgtgccctaygcaaatgaaaaggata

SEQ ID NO: 1557 - DNA, 33 bp, homo sapien
gagaatcttgaggcctrattactttcaattaaa

SEQ ID NO: 1558 - DNA, 33 bp, homo sapien
acttatatttccataarcagcagaaagccattg

SEQ ID NO: 1559 - DNA, 33 bp, homo sapien
agcttctgttttctgcyagtgagtaaattaagg

SEQ ID NO: 1560 - DNA, 33 bp, homo sapien
aaccacattcacatacrtgccataagtccctga

SEQ ID NO: 1561 - DNA, 33 bp, homo sapien
cttttctccactctgartacccagtgagtttcc

SEQ ID NO: 1562 - DNA, 33 bp, homo sapien
acggagaatccagtatyggtggcccactggctc

SEQ ID NO: 1563 - DNA, 33 bp, homo sapien
atgaacataaagatggwaacgatgctgaggact

SEQ ID NO: 1564 - DNA, 33 bp, homo sapien
tccacatttcaccatargcgtgcatgcagttaa

SEQ ID NO: 1565 - DNA, 33 bp, homo sapien
gtctccaaccatttttycttctttgctcttaat

SEQ ID NO: 1566 - DNA, 33 bp, homo sapien
atcatgaaagagatagyggatatggcaaaaatg

SEQ ID NO: 1567 - DNA, 33 bp, homo sapien
aatatcccttggaagasagtggtagaaatgggg

SEQ ID NO: 1568 - DNA, 33 bp, homo sapien
catgtcacaaaaccacrgacacatttcacaaca

SEQ ID NO: 1569 - DNA, 33 bp, homo sapien
cttggttttcctttatyagccttttaatgtctg

SEQ ID NO: 1570 - DNA, 33 bp, homo sapien
ccacccagtcactgccytaattttccacatcag

SEQ ID NO: 1571 - DNA, 33 bp, homo sapien
tcagaatcacctattcraaaggcgaatccgatc

SEQ ID NO: 1572 - DNA, 33 bp, homo sapien
gctgaacagtgacactygtgcctggcatgctcc

SEQ ID NO: 1573 - DNA, 33 bp, homo sapien
tctactacatataaagygctctggaaggtagaa

SEQ ID NO: 1574 - DNA, 33 bp, homo sapien
acagtcaaaatgtgaayagaccagtcaaatcct

SEQ ID NO: 1575 - DNA, 33 bp, homo sapien
ttatagacagaattgtrtcctctctgcaaaatt

SEQ ID NO: 1576 - DNA, 33 bp, homo sapien
attcaaaaggcgaatcygatcatgtggttcctg

SEQ ID NO: 1577 - DNA, 33 bp, homo sapien
ttgcccaccctcacttstgtggctactgttctc

SEQ ID NO: 1578 - DNA, 33 bp, homo sapien
tcgggagacagtgccaygtaaagttctttgatt

SEQ ID NO: 1579 - DNA, 33 bp, homo sapien
tcgtttctggatttttycataatcgccattctg

SEQ ID NO: 1580 - DNA, 33 bp, homo sapien
cctccccaacagatgcktccatcccagcttctc

SEQ ID NO: 1581 - DNA, 33 bp, homo sapien
aagaataagctaaataygctgagactcagaggt

SEQ ID NO: 1582 - DNA, 33 bp, homo sapien
taagccatcaagaagamtgtttactggagtgga

SEQ ID NO: 1583 - DNA, 33 bp, homo sapien
ttggtcacaccaagaaygaaagggacgatattt

SEQ ID NO: 1584 - DNA, 33 bp, homo sapien
ctaaagttgctatattmtttttcttctgatgga

SEQ ID NO: 1585 - DNA, 33 bp, homo sapien
aggctctcgggggaatygttctggaggctctgg

SEQ ID NO: 1586 - DNA, 33 bp, homo sapien
ctgtggtctggggatamagaataagccaagtcc

SEQ ID NO: 1587 - DNA, 33 bp, homo sapien
caggagacaagtcgccmaaaattctaggtaatg

SEQ ID NO: 1588 - DNA, 33 bp, homo sapien
gacagagttggagcaamtgagactcagattaag

SEQ ID NO: 1589 - DNA, 33 bp, homo sapien
agtgacaactgttcttstctctggatcctgatt

SEQ ID NO: 1590 - DNA, 33 bp, homo sapien
tcatcaaggcttttgayacttattgccaaattt

SEQ ID NO: 1591 - DNA, 33 bp, homo sapien
tattaagtattgtattmgtttcctcttgctgct

SEQ ID NO: 1592 - DNA, 33 bp, homo sapien
tgcacacttgtaaagaygagtgatgttatcgtt

SEQ ID NO: 1593 - DNA, 33 bp, homo sapien
attctgtttttcacttwcagtacggtagtcaat

SEQ ID NO: 1594 - DNA, 33 bp, homo sapien
atgcaaataatggatgrcaaatgctgagcagaa

SEQ ID NO: 1595 - DNA, 33 bp, homo sapien
tgttaaaatgtcttccrtttgcattttaaatag

SEQ ID NO: 1596 - DNA, 33 bp, homo sapien
aacctgtgaacattttrtcttaaatggtaaaag

SEQ ID NO: 1597 - DNA, 33 bp, homo sapien
gtggaatgcatgataakctgggttcttaaaaat

SEQ ID NO: 1598 - DNA, 33 bp, homo sapien
tgatcctgtgcacatartgggtcctgagtattt

SEQ ID NO: 1599 - DNA, 33 bp, homo sapien
aacatctagtatcaaarcatgttcaactggaac

SEQ ID NO: 1600 - DNA, 33 bp, homo sapien
aagctgttttttatttycctcctatgttgattc

SEQ ID NO: 1601 - DNA, 33 bp, homo sapien
tgcttaagattaaagaytaggagtggccatggt

SEQ ID NO: 1602 - DNA, 33 bp, homo sapien
tgtataaagagttatgwtctctcaagtcactga

SEQ ID NO: 1603 - DNA, 33 bp, homo sapien
catttcaggtataaagkcaggcgagacaggaag

SEQ ID NO: 1604 - DNA, 33 bp, homo sapien
tgtggagcctttgggarctaattaatgaggttg

SEQ ID NO: 1605 - DNA, 33 bp, homo sapien
ctacatggagttaattragcacaaaatgtgttt

SEQ ID NO: 1606 - DNA, 33 bp, homo sapien
tgggatgaatgttaaarggtaagtgcttggtga

SEQ ID NO: 1607 - DNA, 33 bp, homo sapien
gaataatgaaaatctcrgtaagaaaaaagagtt

SEQ ID NO: 1608 - DNA, 33 bp, homo sapien
agctctgaattaggagracagtgtctaagaatt

SEQ ID NO: 1609 - DNA, 33 bp, homo sapien
ttgtagagtagaatgtrttttatgtcttttatt

SEQ ID NO: 1610 - DNA, 33 bp, homo sapien
gtctccattgtatgaaygctattgtgcccttgc

SEQ ID NO: 1611 - DNA, 33 bp, homo sapien
attaatcttcagttggytgggataaaaactcat

SEQ ID NO: 1612 - DNA, 33 bp, homo sapien
gtcccggactggatccyggactaggaaaaggac

SEQ ID NO: 1613 - DNA, 33 bp, homo sapien
tgataacaatacctaayagcttatctgtctctt

SEQ ID NO: 1614 - DNA, 33 bp, homo sapien
ccctcctttgatgtagmaattatggagttttta

SEQ ID NO: 1615 - DNA, 33 bp, homo sapien
gactatacagaccactmtctacacggaagctgg

SEQ ID NO: 1616 - DNA, 33 bp, homo sapien
acatactttgctgcaaytaattttttccagcct

SEQ ID NO: 1617 - DNA, 33 bp, homo sapien
taaaagacattgtagcrtcagagatatgtctga

SEQ ID NO: 1618 - DNA, 33 bp, homo sapien
taaaatatgtcaggcastaatgctcagtattga

SEQ ID NO: 1619 - DNA, 33 bp, homo sapien
agctgcagtatcttcakttcttacagtggggaa

SEQ ID NO: 1620 - DNA, 33 bp, homo sapien
gactacggactactcartaatttatccagctga

SEQ ID NO: 1621 - DNA, 33 bp, homo sapien
aaacacgtatttgttgmatgttgttgaagagag

SEQ ID NO: 1622 - DNA, 33 bp, homo sapien
tcagaggttcctcgtgycatcttcaggagaaat

SEQ ID NO: 1623 - DNA, 33 bp, homo sapien
ataactttgtgcacttracccatctgtagaaaa

SEQ ID NO: 1624 - DNA, 33 bp, homo sapien
ttagggagtgaggatgsaaaaatagaaaatgtc

SEQ ID NO: 1625 - DNA, 33 bp, homo sapien
gaacagcaacaatttgmaaaatctgtaaaccat

SEQ ID NO: 1626 - DNA, 33 bp, homo sapien
aattgactcattatgcytcgaattttttcatgc

SEQ ID NO: 1627 - DNA, 33 bp, homo sapien
tttcttttattgcaatkaatcttctcattctaa

SEQ ID NO: 1628 - DNA, 33 bp, homo sapien
ccttcggagaaccaccratgcacaggatggtga

SEQ ID NO: 1629 - DNA, 33 bp, homo sapien
ctgacagatgtttgcartaatcataattaatgt

SEQ ID NO: 1630 - DNA, 33 bp, homo sapien
attctagaagctgtggraagaaaaagagggagg

SEQ ID NO: 1631 - DNA, 33 bp, homo sapien
gggagttcctcttggtyctccagacacgcctgc

SEQ ID NO: 1632 - DNA, 33 bp, homo sapien
attttgaagccaaatakaattttttattcatat

SEQ ID NO: 1633 - DNA, 33 bp, homo sapien
gtctagtagacatgacygtgacagttaaaaatg

SEQ ID NO: 1634 - DNA, 33 bp, homo sapien
cctcactgtccactccrtagaagaacaaggcat

SEQ ID NO: 1635 - DNA, 33 bp, homo sapien
ttatttgatttgatttkatttttagacggagtt

SEQ ID NO: 1636 - DNA, 33 bp, homo sapien
gatgaggcagaaaattygcatttccaaaattta

SEQ ID NO: 1637 - DNA, 33 bp, homo sapien
aggagttgctaacaccrctggctcatctctgaa

SEQ ID NO: 1638 - DNA, 33 bp, homo sapien
ctaggatctagcaggasttcaatgtacattgca

SEQ ID NO: 1639 - DNA, 33 bp, homo sapien
gtagacatagctggcaytgagaatgaagagaaa

SEQ ID NO: 1640 - DNA, 33 bp, homo sapien
ggagaacttcttttgcwccttaaaatacttcat

SEQ ID NO: 1641 - DNA, 33 bp, homo sapien
tatatgtgtagttttartaagtcttaacttttt

SEQ ID NO: 1642 - DNA, 33 bp, homo sapien
ccaacacacatccaagstcccacagttatccat

SEQ ID NO: 1643 - DNA, 33 bp, homo sapien
ctatttctgaccttctmattcctttctttagca

SEQ ID NO: 1644 - DNA, 33 bp, homo sapien
caatttatatgaatcgrtaatcttccagacttt

SEQ ID NO: 1645 - DNA, 33 bp, homo sapien
atagccattagaacctscagatgtcttctgaga

SEQ ID NO: 1646 - DNA, 33 bp, homo sapien
cacctacgctaagtcawcttgtgcaattttcca

SEQ ID NO: 1647 - DNA, 33 bp, homo sapien
ggctggagctacacacygtcaaattaaggctca

SEQ ID NO: 1648 - DNA, 33 bp, homo sapien
taaactgaaatatctgygcatgcaatagaggtt

SEQ ID NO: 1649 - DNA, 33 bp, homo sapien
gaaacacccttacttayggcacagaattaaatg

SEQ ID NO: 1650 - DNA, 33 bp, homo sapien
gatacaaactggtcccygataaaaactggtcta

SEQ ID NO: 1651 - DNA, 33 bp, homo sapien
ccatgcccttttcaagrctcaacacactttgct

SEQ ID NO: 1652 - DNA, 33 bp, homo sapien
cactttgcaacatttgracaatgatgaagtcac

SEQ ID NO: 1653 - DNA, 33 bp, homo sapien
ataatcttcagtccttrtccacattttgccaaa

SEQ ID NO: 1654 - DNA, 33 bp, homo sapien
ttgatgtgttttaacayggatattttgcactaa

SEQ ID NO: 1655 - DNA, 33 bp, homo sapien
tacatgccaatcaagargaaaggaggaggggtc

SEQ ID NO: 1656 - DNA, 33 bp, homo sapien
actgccagtttgcccascactttgccagcgtaa

SEQ ID NO: 1657 - DNA, 33 bp, homo sapien
tcgaattatgccactcyataaatttgttctttc

SEQ ID NO: 1658 - DNA, 33 bp, homo sapien
cagccggaagcatacaygcccattggatttcag

SEQ ID NO: 1659 - DNA, 33 bp, homo sapien
gaataaagacaaatgakaacagatctaccttag

SEQ ID NO: 1660 - DNA, 33 bp, homo sapien
tagtacaagataatgcygctgtgctatgaatag

SEQ ID NO: 1661 - DNA, 33 bp, homo sapien
atcaagcctagttactyttggcccaccactctg

SEQ ID NO: 1662 - DNA, 33 bp, homo sapien
ctttccaaggactctgkgtcagcagctgtgaag

SEQ ID NO: 1663 - DNA, 33 bp, homo sapien
ctctgaagttcctccarttcagaaagggatggg

SEQ ID NO: 1664 - DNA, 33 bp, homo sapien
ttgaaacatttcaggcratctgacatactagag

SEQ ID NO: 1665 - DNA, 33 bp, homo sapien
tatgctgacatcaagcyactaaaattactcttt

SEQ ID NO: 1666 - DNA, 33 bp, homo sapien
ctctgtttggccgtccrtggtggcagtcagcgc

SEQ ID NO: 1667 - DNA, 33 bp, homo sapien
atcaacaattatcaagygtcaaaaattaagata

SEQ ID NO: 1668 - DNA, 33 bp, homo sapien
atattcttacaaaattyacatggtagagcttat

SEQ ID NO: 1669 - DNA, 33 bp, homo sapien
ttaaaccgggtaatctrcttctaagccttaaga

SEQ ID NO: 1670 - DNA, 33 bp, homo sapien
gtaattgctacaaactratgactaatgatattc

SEQ ID NO: 1671 - DNA, 33 bp, homo sapien
tattttcttttccttgrgtaatgaatgcaatga

SEQ ID NO: 1672 - DNA, 33 bp, homo sapien
atgtagtcagttacaawtcaaacatttaaaatt

SEQ ID NO: 1673 - DNA, 33 bp, homo sapien
agatattaaacacaagkataatgaatcaggaac

SEQ ID NO: 1674 - DNA, 33 bp, homo sapien
tatgtaagagctgaaaytgtaaaagtgcaatcc

SEQ ID NO: 1675 - DNA, 33 bp, homo sapien
tgtgtataaaaacttayagagctagcatgaggc

SEQ ID NO: 1676 - DNA, 33 bp, homo sapien
tataaagcatgctactrctaatcaattagtttt

SEQ ID NO: 1677 - DNA, 33 bp, homo sapien
ggggaaagataatgtgstaaaggcagatcctct

SEQ ID NO: 1678 - DNA, 33 bp, homo sapien
actttatctgttctgtycctacagtgatttatg

SEQ ID NO: 1679 - DNA, 33 bp, homo sapien
ttttttgtggcaaagargatcacaataattcaa

SEQ ID NO: 1680 - DNA, 33 bp, homo sapien
tcatctatagtaatcawttttatgtatatgtta

SEQ ID NO: 1681 - DNA, 33 bp, homo sapien
tactgtagctctgaacrgagagtgacatgatca

SEQ ID NO: 1682 - DNA, 33 bp, homo sapien
cagctgggtttagagayagctgattttcatatt

SEQ ID NO: 1683 - DNA, 33 bp, homo sapien
gaagccaaacatacttstaggcattttattgaa

SEQ ID NO: 1684 - DNA, 33 bp, homo sapien
tgctttgtctttggacrttttcacctttaacca

SEQ ID NO: 1685 - DNA, 33 bp, homo sapien
aaaagtgacagttggcwcagtggaaacaaaaga

SEQ ID NO: 1686 - DNA, 33 bp, homo sapien
ctaggctctgctgcatrtaacaagcctgtcatt

SEQ ID NO: 1687 - DNA, 33 bp, homo sapien
ttatgtaaggctcaccrtgtcaactaacacaaa

SEQ ID NO: 1688 - DNA, 33 bp, homo sapien
gtaaaaagggttaaatkgtgactaatcgtaata

SEQ ID NO: 1689 - DNA, 33 bp, homo sapien
tactttctcagaaatartgttttccaataattc

SEQ ID NO: 1690 - DNA, 33 bp, homo sapien
agaaacaggatttagtyacccttgatgcaggct

SEQ ID NO: 1691 - DNA, 33 bp, homo sapien
gcacttagggtagcacrtggcacacagcatgca

SEQ ID NO: 1692 - DNA, 33 bp, homo sapien
ggattgtttcagcctcwaatttaacttctggga

SEQ ID NO: 1693 - DNA, 33 bp, homo sapien
cttgatcttaacctcarttctgcttcttattaa

SEQ ID NO: 1694 - DNA, 33 bp, homo sapien
tctgaggattcaaaacyaaaatgctattcctaa

SEQ ID NO: 1695 - DNA, 33 bp, homo sapien
atcacggttaaggaaakaagctggttaataaaa

SEQ ID NO: 1696 - DNA, 33 bp, homo sapien
ttttaaaaaaatactcrttggaaacagagcaac

SEQ ID NO: 1697 - DNA, 33 bp, homo sapien
agggcattttccaaggyaccactgttaaatagc

SEQ ID NO: 1698 - DNA, 33 bp, homo sapien
ttctttggtggtgtttytttgagacagagtctc

SEQ ID NO: 1699 - DNA, 33 bp, homo sapien
caggtcatccaaccctktaagccagcaggtgaa

SEQ ID NO: 1700 - DNA, 33 bp, homo sapien
cgtgctctgagataaayagccagagtctttaag

SEQ ID NO: 1701 - DNA, 33 bp, homo sapien
ataaaaagctattcatytgaaaacttgaacaaa

SEQ ID NO: 1702 - DNA, 33 bp, homo sapien
tgggctaattctatgargtcagtcactttttcc

SEQ ID NO: 1703 - DNA, 33 bp, homo sapien
tttaattgttcattcasttgctcaacaactttc

SEQ ID NO: 1704 - DNA, 33 bp, homo sapien
cacaggcatttatatcwggtctcttcacaaacg

SEQ ID NO: 1705 - DNA, 33 bp, homo sapien
aatatatactcttaccrgtcaataaggcagaca

SEQ ID NO: 1706 - DNA, 33 bp, homo sapien
gtttatcccagcttaayattttaacccagccaa

SEQ ID NO: 1707 - DNA, 33 bp, homo sapien
accaatcatctgaatcyatgcagaaaaaaatag

SEQ ID NO: 1708 - DNA, 33 bp, homo sapien
ttttgtaatgagcattrtgaagtttaacatgta

SEQ ID NO: 1709 - DNA, 33 bp, homo sapien
aaccaatctgtcactaytggccagaacaagcaa

SEQ ID NO: 1710 - DNA, 33 bp, homo sapien
tgtgtgaaacatattaycatcatattgattcca

SEQ ID NO: 1711 - DNA, 33 bp, homo sapien
gttggctttagtgcttyaatctaaagaggacac

SEQ ID NO: 1712 - DNA, 33 bp, homo sapien
tgtgaagaattcagtgyagatattcgctgcaat

SEQ ID NO: 1713 - DNA, 33 bp, homo sapien
aatgccaattttatgtwagagctgaaattgtaa

SEQ ID NO: 1714 - DNA, 33 bp, homo sapien
taaggaagtcatagagkacacttatgggatgag

SEQ ID NO: 1715 - DNA, 33 bp, homo sapien
ttaagtttggcagtctygttctctataaaacaa

SEQ ID NO: 1716 - DNA, 33 bp, homo sapien
atatttgtattgcttcrtccctgccccatagta

SEQ ID NO: 1717 - DNA, 33 bp, homo sapien
atgccacttgcattatwtgccaaatgaaagaga

SEQ ID NO: 1718 - DNA, 33 bp, homo sapien
tcttctctatagcttamaaaataatctccataa

SEQ ID NO: 1719 - DNA, 33 bp, homo sapien
tgagtaagttgaaccayttttgcatcactggga

SEQ ID NO: 1720 - DNA, 33 bp, homo sapien
taaaatctggcatttckcccattattcccattc

SEQ ID NO: 1721 - DNA, 33 bp, homo sapien
cgacctgggcaattcarcctattggtgtggagg

SEQ ID NO: 1722 - DNA, 33 bp, homo sapien
cttatttccttctcacyacagagaactgggcta

SEQ ID NO: 1723 - DNA, 33 bp, homo sapien
ggagtcacaggacaaamcttgaaatgaggttat

SEQ ID NO: 1724 - DNA, 33 bp, homo sapien
tattttaaagaatctgstgactgattcacacta

SEQ ID NO: 1725 - DNA, 33 bp, homo sapien
taggtatttgtgctaaygatctctgtctccttg

SEQ ID NO: 1726 - DNA, 33 bp, homo sapien
taaaaaagtctactaaraattcagtgaatatgc

SEQ ID NO: 1727 - DNA, 33 bp, homo sapien
tcttgttaaatacctargcatctcaaaaaaaaa

SEQ ID NO: 1728 - DNA, 33 bp, homo sapien
cacattggctaggaaartgaatatttactttga

SEQ ID NO: 1729 - DNA, 33 bp, homo sapien
tatgggatagaaaagtwacagttgtcccaagta

SEQ ID NO: 1730 - DNA, 33 bp, homo sapien
cccctgctttacagtaragagtgtccatcctcc

SEQ ID NO: 1731 - DNA, 33 bp, homo sapien
tgtgggtggagaccgcrtaatcaaggaactgat

SEQ ID NO: 1732 - DNA, 33 bp, homo sapien
agttgtgtgggcactamtccctttagatcttta

SEQ ID NO: 1733 - DNA, 33 bp, homo sapien
ctgaaactaagttgttstctaacattccaagga

SEQ ID NO: 1734 - DNA, 33 bp, homo sapien
tattttaaatgctaaartgatgtgtaaaatata

SEQ ID NO: 1735 - DNA, 33 bp, homo sapien
caggtgatcctgcggawgagctcccaatttgtg

SEQ ID NO: 1736 - DNA, 33 bp, homo sapien
acgaacaagatcaatarccagtgtgatgtcagt

SEQ ID NO: 1737 - DNA, 33 bp, homo sapien
tacaacagctgcaatgkataacagcttcccaac

SEQ ID NO: 1738 - DNA, 33 bp, homo sapien
atgagaaaaaggctgtwttcagtgcagacctgg

SEQ ID NO: 1739 - DNA, 33 bp, homo sapien
ttataatcataacaagmcattgcatttgatcct

SEQ ID NO: 1740 - DNA, 33 bp, homo sapien
ttctgtattactcttgyagttgtttacttgttg

SEQ ID NO: 1741 - DNA, 33 bp, homo sapien
atggaccactccaaagygtgtgggttgctagaa

SEQ ID NO: 1742 - DNA, 33 bp, homo sapien
cactttgcaaaacactyacaaataggttcagtg

SEQ ID NO: 1743 - DNA, 33 bp, homo sapien
agtcttatttttgctgraggaatttttattaca

SEQ ID NO: 1744 - DNA, 33 bp, homo sapien
aaaagacaaccaatccrctgaataagagagact

SEQ ID NO: 1745 - DNA, 33 bp, homo sapien
cattccataaaataggwtaagtgtctcgatgag

SEQ ID NO: 1746 - DNA, 33 bp, homo sapien
ttacttttgctatccaytgaattgttaccatca

SEQ ID NO: 1747 - DNA, 33 bp, homo sapien
aggtagattcttagctsggccataagcccccca

SEQ ID NO: 1748 - DNA, 33 bp, homo sapien
ttagctttaaaactcakatctaacaaagtaaca

SEQ ID NO: 1749 - DNA, 33 bp, homo sapien
ctaattaaaggcttgaycctgggaagcagcagt

SEQ ID NO: 1750 - DNA, 33 bp, homo sapien
ttgtcctggaggcatcsgaaatcggttcagatc

SEQ ID NO: 1751 - DNA, 33 bp, homo sapien
caagtctcatttgtctktgatccctgaagcaac

SEQ ID NO: 1752 - DNA, 33 bp, homo sapien
catcacattccaacatrtattagtctgccatct

SEQ ID NO: 1753 - DNA, 33 bp, homo sapien
atgtttgtgccacaagmatgttaagttccatga

SEQ ID NO: 1754 - DNA, 33 bp, homo sapien
acttctggttgaaagartgcttgtctccaattt

SEQ ID NO: 1755 - DNA, 33 bp, homo sapien
gctagttctaggcgcayttccttggactcaggt

SEQ ID NO: 1756 - DNA, 33 bp, homo sapien
aataaaaagatctaaamattgcaccatgtcaaa

SEQ ID NO: 1757 - DNA, 33 bp, homo sapien
caacttatgtcaaagckcagggtcacaggagag

SEQ ID NO: 1758 - DNA, 33 bp, homo sapien
tttgtgaaatctcaacstaggagcaggttgaat

SEQ ID NO: 1759 - DNA, 33 bp, homo sapien
taatgtttgctttgctstctctgcctttaacat

SEQ ID NO: 1760 - DNA, 33 bp, homo sapien
ccatctctatctcatgyggatttatgtccacag

SEQ ID NO: 1761 - DNA, 33 bp, homo sapien
acttatatatttaaagytgtgtgccaggttgtt

SEQ ID NO: 1762 - DNA, 33 bp, homo sapien
aacgcagcaagaaaggyctggggcaagaagaca

SEQ ID NO: 1763 - DNA, 33 bp, homo sapien
cggtaggctaggaactrtagtagatactgacta

SEQ ID NO: 1764 - DNA, 33 bp, homo sapien
gaggtaacccggcatcmtggagaaaaatactca

SEQ ID NO: 1765 - DNA, 33 bp, homo sapien
atgcttttctattttaygcagcaggtttagatc

SEQ ID NO: 1766 - DNA, 33 bp, homo sapien
tttgcatgcttattttstaacgtcataatcaga

SEQ ID NO: 1767 - DNA, 33 bp, homo sapien
ctgttaccatcagatcrtcttaatcctattgac

SEQ ID NO: 1768 - DNA, 33 bp, homo sapien
gaattaataataccgtkttagatgcaaatggca

SEQ ID NO: 1769 - DNA, 33 bp, homo sapien
tctacttccaagtcctrtcttcttttcacttca

SEQ ID NO: 1770 - DNA, 33 bp, homo sapien
atgttgggaatctttcyaacaaaaaggtgacct

SEQ ID NO: 1771 - DNA, 33 bp, homo sapien
acagaaattctcattamagtcaagactaatgaa

SEQ ID NO: 1772 - DNA, 33 bp, homo sapien
cccagaatgtatcattkttgcatttgattgtcc

SEQ ID NO: 1773 - DNA, 33 bp, homo sapien
gctactttctagtaaarattctaaacagtgtaa

SEQ ID NO: 1774 - DNA, 33 bp, homo sapien
ttgcgctacatagattkttgtttcggggaaggg

SEQ ID NO: 1775 - DNA, 33 bp, homo sapien
tgtttttatttattttyctgtatcagtgtgtta

SEQ ID NO: 1776 - DNA, 33 bp, homo sapien
tttgagatgcactcatrtttttgcataaaggaa

SEQ ID NO: 1777 - DNA, 33 bp, homo sapien
taccttcatactttttkgtttcctggcttctat

SEQ ID NO: 1778 - DNA, 33 bp, homo sapien
atttgaccttgagaaawtaaatcttcatgccat

SEQ ID NO: 1779 - DNA, 33 bp, homo sapien
ctttttcttttttcctrtagcaattatcacccc

SEQ ID NO: 1780 - DNA, 33 bp, homo sapien
cttcaatatgttttatyatcctgtttctgctaa

SEQ ID NO: 1781 - DNA, 33 bp, homo sapien
tgagcctctggtcacaygttcctcaactgatcc

SEQ ID NO: 1782 - DNA, 33 bp, homo sapien
tgattgtcatcttaccytggaagtctccatgtt

SEQ ID NO: 1783 - DNA, 33 bp, homo sapien
ttaggctaaatctactrttgaggtttactactc

SEQ ID NO: 1784 - DNA, 33 bp, homo sapien
acctgatttccattctrgttctacccatggaca

SEQ ID NO: 1785 - DNA, 33 bp, homo sapien
actagaccagccttaamagagatccttaaaaga

SEQ ID NO: 1786 - DNA, 33 bp, homo sapien
tagcatttgagttactsaactgggagtcgcaga

SEQ ID NO: 1787 - DNA, 33 bp, homo sapien
gagagactatgatttaygaaattcacatatatg

SEQ ID NO: 1788 - DNA, 33 bp, homo sapien
caagggattgttaaatratttctgagcagtata

SEQ ID NO: 1789 - DNA, 33 bp, homo sapien
gaccgagtatggaaaaygcatgtcaaagacctt

SEQ ID NO: 1790 - DNA, 33 bp, homo sapien
ggtcaggtctccttacyggcaagtgtttgcagc

SEQ ID NO: 1791 - DNA, 33 bp, homo sapien
agcatgcattttcaaawtcactacagctgtccc

SEQ ID NO: 1792 - DNA, 33 bp, homo sapien
atgtgaaaagttgtgtmatcattgtgtttcttt

SEQ ID NO: 1793 - DNA, 33 bp, homo sapien
aaaaaaaaaaatcgcaracaaatctcataatgt

SEQ ID NO: 1794 - DNA, 33 bp, homo sapien
caggaagagcccacagstttcaaatttataagt

SEQ ID NO: 1795 - DNA, 33 bp, homo sapien
atgatttttcactttgratatctaggtagaatc

SEQ ID NO: 1796 - DNA, 33 bp, homo sapien
atttctaattttatccrcatcattctcctatac

SEQ ID NO: 1797 - DNA, 33 bp, homo sapien
gcatgtactctccacgscataatttgtaaatgc

SEQ ID NO: 1798 - DNA, 33 bp, homo sapien
gtacattttctaggttscacattcgtctcccat

SEQ ID NO: 1799 - DNA, 33 bp, homo sapien
gcagtcggcattaagcrctgaagagaaagaaag

SEQ ID NO: 1800 - DNA, 33 bp, homo sapien
tttgatgcatttctccrtaccaagaaaattcaa

SEQ ID NO: 1801 - DNA, 33 bp, homo sapien
atacaacagagatgagwaataaatattaaacaa

SEQ ID NO: 1802 - DNA, 33 bp, homo sapien
agcaaataaagtcacargatgcccagttcaatt

SEQ ID NO: 1803 - DNA, 33 bp, homo sapien
acatacttgtcatgtcrcgaaaacatctaggac

SEQ ID NO: 1804 - DNA, 33 bp, homo sapien
ttcaaatttgctgataytttcttccgcctgctc

SEQ ID NO: 1805 - DNA, 33 bp, homo sapien
atataacccagaatacrgaagtacatcggtgaa

SEQ ID NO: 1806 - DNA, 33 bp, homo sapien
tgttttttctgcaatartgtaataatagttcat

SEQ ID NO: 1807 - DNA, 33 bp, homo sapien
ctgcttagaagataacygctatgacacactgac

SEQ ID NO: 1808 - DNA, 33 bp, homo sapien
cctcaaacttgtgtttyatgaatcctctcttag

SEQ ID NO: 1809 - DNA, 33 bp, homo sapien
ctggtttcacctcttcwtcattcagaatttgtt

SEQ ID NO: 1810 - DNA, 33 bp, homo sapien
tggtttgtatcagaagygttttgtgtaaatagt

SEQ ID NO: 1811 - DNA, 33 bp, homo sapien
tctgccattccacgtgrttgctaaaccctagga

SEQ ID NO: 1812 - DNA, 33 bp, homo sapien
gttacagtgcaagaaayggcagtcatcaaacta

SEQ ID NO: 1813 - DNA, 33 bp, homo sapien
tgttttgacttaaaatrtaccattcatcagtta

SEQ ID NO: 1814 - DNA, 33 bp, homo sapien
catattgattccctgcmaaaccaaacttgatga

SEQ ID NO: 1815 - DNA, 33 bp, homo sapien
agtctaagtgtttcatytagtgtggaaattaag

SEQ ID NO: 1816 - DNA, 33 bp, homo sapien
tgccagtcagagttgargcaccaagaagcagag

SEQ ID NO: 1817 - DNA, 33 bp, homo sapien
aaatcagcatcactccytttaaaggataaaggt

SEQ ID NO: 1818 - DNA, 33 bp, homo sapien
ccttcagagcaatattktcttggctatgacttc

SEQ ID NO: 1819 - DNA, 33 bp, homo sapien
tgctctttggttacatkaactgacttttgttga

SEQ ID NO: 1820 - DNA, 33 bp, homo sapien
aatctccaaagctattrggactatgcactagag

SEQ ID NO: 1821 - DNA, 33 bp, homo sapien
gtacactatttattgasgtaccagatggtgtga

SEQ ID NO: 1822 - DNA, 33 bp, homo sapien
tttccctcttaaattgygaagttgtcaagtcag

SEQ ID NO: 1823 - DNA, 33 bp, homo sapien
cctcatgattttctctkcaatttaacattcata

SEQ ID NO: 1824 - DNA, 33 bp, homo sapien
catttattcctcagctrtgacattctaaatgct

SEQ ID NO: 1825 - DNA, 33 bp, homo sapien
ggtttgtagagtgaaarttgagcaaatctgcat

SEQ ID NO: 1826 - DNA, 33 bp, homo sapien
accaccaaacctgatckcaggctcgtgttaaca

SEQ ID NO: 1827 - DNA, 33 bp, homo sapien
gcagcttttatcattayggcatcatcgtcatct

SEQ ID NO: 1828 - DNA, 33 bp, homo sapien
aagcacgttttttgctrgacagaactatctgat

SEQ ID NO: 1829 - DNA, 33 bp, homo sapien
tttagcgatcatgtatraaaacattacactcac

SEQ ID NO: 1830 - DNA, 33 bp, homo sapien
cccattgatggatgaayagaaaatgtgatatat

SEQ ID NO: 1831 - DNA, 33 bp, homo sapien
atgtctcagctaccaasactgtgttctttgatc

SEQ ID NO: 1832 - DNA, 33 bp, homo sapien
tttattaatgtttcttsctgaatatttttgatc

SEQ ID NO: 1833 - DNA, 33 bp, homo sapien
tccttgaggcaactcayctctgactcagaactt

SEQ ID NO: 1834 - DNA, 33 bp, homo sapien
gtaatgaaagctatttytgaacatgaggcctct

SEQ ID NO: 1835 - DNA, 33 bp, homo sapien
ggtgaaagtcacaggarggcatactacagtgga

SEQ ID NO: 1836 - DNA, 33 bp, homo sapien
aagaaacgagtcctgckgctgattgcttagaca

SEQ ID NO: 1837 - DNA, 33 bp, homo sapien
aggcttgataaggtcayccaaaaatgtccatat

SEQ ID NO: 1838 - DNA, 33 bp, homo sapien
ctaggctactggcttcrcataattttcatatag

SEQ ID NO: 1839 - DNA, 33 bp, homo sapien
tcaatagagaatatccraattgaagtcgagagg

SEQ ID NO: 1840 - DNA, 33 bp, homo sapien
aaaaggacaaaaagaaytgtaaaggtcaaggga

SEQ ID NO: 1841 - DNA, 33 bp, homo sapien
caaagttgcacactagstacagcagagaccttc

SEQ ID NO: 1842 - DNA, 33 bp, homo sapien
tgtatccatcttgtatmttttcaaaacactcat

SEQ ID NO: 1843 - DNA, 33 bp, homo sapien
ctttactcttatgtcakcctatttaactgtgcc

SEQ ID NO: 1844 - DNA, 33 bp, homo sapien
tgaacatggcaagaggyatcatccataaaaaat

SEQ ID NO: 1845 - DNA, 33 bp, homo sapien
gagacacttacctgggkatgtaaagactatggt

SEQ ID NO: 1846 - DNA, 33 bp, homo sapien
caaactggactgggtaytccctattgtttctgg

SEQ ID NO: 1847 - DNA, 33 bp, homo sapien
gagcataatctcatttrcaatctctgagaacca

SEQ ID NO: 1848 - DNA, 33 bp, homo sapien
gtaaaaggctacaccamctacataagcagctct

SEQ ID NO: 1849 - DNA, 33 bp, homo sapien
ctaagaaaacagaaaakcccagtattacttggt

SEQ ID NO: 1850 - DNA, 33 bp, homo sapien
gctgagttacacccaaygtgcaggtggtcatta

SEQ ID NO: 1851 - DNA, 33 bp, homo sapien
aacagcttgctgtgggwtgtcactttttaatat

SEQ ID NO: 1852 - DNA, 33 bp, homo sapien
aggctgagaaatagcarcaaagatttctacatc

SEQ ID NO: 1853 - DNA, 33 bp, homo sapien
agcacatgttaagtggyaatgttccatgcaata

SEQ ID NO: 1854 - DNA, 33 bp, homo sapien
ttcaaaattcctaaatyatgatcccagtgctgt

SEQ ID NO: 1855 - DNA, 33 bp, homo sapien
tgttattttatagacgmtgagttgaaagcccag

SEQ ID NO: 1856 - DNA, 33 bp, homo sapien
tctaattcagtcatgtmtttccacagatgggga

SEQ ID NO: 1857 - DNA, 33 bp, homo sapien
gtgacaggtaaaagaasagagctccagaacagc

SEQ ID NO: 1858 - DNA, 33 bp, homo sapien
tctgcagtagcaaccaytgcattgtattttaag

SEQ ID NO: 1859 - DNA, 33 bp, homo sapien
gtcccggcaatggcgtracatcaccaggccaca

SEQ ID NO: 1860 - DNA, 33 bp, homo sapien
ttacctaatgtttattrtataccagatgtgatg

SEQ ID NO: 1861 - DNA, 33 bp, homo sapien
gtcttcatgtcacctaktcagaagttcatatca

SEQ ID NO: 1862 - DNA, 33 bp, homo sapien
tcggacttcagaagtawgtttctatgttaggtt

SEQ ID NO: 1863 - DNA, 33 bp, homo sapien
accattcagctgaatgyagccctatcagtgatc

SEQ ID NO: 1864 - DNA, 33 bp, homo sapien
ggagtgggtctggagcrtccatgtggctgaatt

SEQ ID NO: 1865 - DNA, 33 bp, homo sapien
aggtgtgtaaaagatgytagaggagcatagagg

SEQ ID NO: 1866 - DNA, 33 bp, homo sapien
ggccgagtcctacaatwacacatgacagagcca

SEQ ID NO: 1867 - DNA, 33 bp, homo sapien
attccctttttgacctstcatttcctcccttga

SEQ ID NO: 1868 - DNA, 33 bp, homo sapien
aatggctgttaaaaaawttcacattcatatttt

SEQ ID NO: 1869 - DNA, 33 bp, homo sapien
agtagactaatggatamaataaggcagatgatc

SEQ ID NO: 1870 - DNA, 33 bp, homo sapien
gcctcccgatgactaayttcaacagctaaatgg

SEQ ID NO: 1871 - DNA, 33 bp, homo sapien
ccctcctgccttggttsttctcaaaccagagtg

SEQ ID NO: 1872 - DNA, 33 bp, homo sapien
gttcacatgaccatgargtgggttcacataacc

SEQ ID NO: 1873 - DNA, 33 bp, homo sapien
agaaaggcttgttagcrtaagccactgagtttt

SEQ ID NO: 1874 - DNA, 33 bp, homo sapien
ggaggagtattcctacyggtttggatattggga

SEQ ID NO: 1875 - DNA, 33 bp, homo sapien
ctgccttgcaagaaacrttaacagaagttcttc

SEQ ID NO: 1876 - DNA, 33 bp, homo sapien
atgtatggttgagattktctcatagagaactga

SEQ ID NO: 1877 - DNA, 33 bp, homo sapien
gcatagggtaaatgctwcttaactggtagttac

SEQ ID NO: 1878 - DNA, 33 bp, homo sapien
taatttttgtcaatccrtaatctgataggtgtg

SEQ ID NO: 1879 - DNA, 33 bp, homo sapien
catcattatggaaattstagcactcttaagaat

SEQ ID NO: 1880 - DNA, 33 bp, homo sapien
caaccacaaagcacacrtgggcatttgctcagc

SEQ ID NO: 1881 - DNA, 33 bp, homo sapien
tgtctcacagtatagaygctggagccagactgc

SEQ ID NO: 1882 - DNA, 33 bp, homo sapien
gatgctaagcagaaccrgaaagtaaaacagaaa

SEQ ID NO: 1883 - DNA, 33 bp, homo sapien
acttatgccattcaagrataaaaatgattagag

SEQ ID NO: 1884 - DNA, 33 bp, homo sapien
gctccactccttactakctgtgtgatcttgact

SEQ ID NO: 1885 - DNA, 33 bp, homo sapien
tgctgttgttttctgtytatcctgctaggcttt

SEQ ID NO: 1886 - DNA, 33 bp, homo sapien
ccagtgaagagtgacakcaaaaatcatagctga

SEQ ID NO: 1887 - DNA, 33 bp, homo sapien
aaaattaaacagtgacyggaagagcttgtattt

SEQ ID NO: 1888 - DNA, 33 bp, homo sapien
ttctccccactgacatktttcctcactttcttc

SEQ ID NO: 1889 - DNA, 33 bp, homo sapien
ttaaaagtcatttccasttaaaaaaatgagaac

SEQ ID NO: 1890 - DNA, 33 bp, homo sapien
tctgacctccataatcrtaagataatatttacg

SEQ ID NO: 1891 - DNA, 33 bp, homo sapien
aagttttcacaaataasataaacaagttagaag

SEQ ID NO: 1892 - DNA, 33 bp, homo sapien
cgagattggagagattsatctacaagtcaagga

SEQ ID NO: 1893 - DNA, 33 bp, homo sapien
ggtgagcaaacaaatcwgtaactaccactctca

SEQ ID NO: 1894 - DNA, 33 bp, homo sapien
ctgagatttccatgagrccttcagagatccatt

SEQ ID NO: 1895 - DNA, 33 bp, homo sapien
tagagacaggaggatcrggtagaataatactca

SEQ ID NO: 1896 - DNA, 33 bp, homo sapien
gcccagtgagagaagaygcacctcagggaacag

SEQ ID NO: 1897 - DNA, 33 bp, homo sapien
acactgctgtaaaaagygagttaagaaggaaaa

SEQ ID NO: 1898 - DNA, 33 bp, homo sapien
aagtgtaccaatagctstatataatagtagaaa

SEQ ID NO: 1899 - DNA, 33 bp, homo sapien
ttataagttccaggcckcctgtttttactcaac

SEQ ID NO: 1900 - DNA, 33 bp, homo sapien
tgatttcacttacacaraaaatttcgcagtgag

SEQ ID NO: 1901 - DNA, 33 bp, homo sapien
cgctgtccaggagtgcyctgtatataagtccta

SEQ ID NO: 1902 - DNA, 33 bp, homo sapien
agacaatatcaggttascgtcaacattaatcca

SEQ ID NO: 1903 - DNA, 33 bp, homo sapien
agactgaaggctgcatygtcagcttccctactt

SEQ ID NO: 1904 - DNA, 33 bp, homo sapien
agttttcacgctaaaaytgagattctttcagcc

SEQ ID NO: 1905 - DNA, 33 bp, homo sapien
catatggtagattacaytgatagattttaaacc

SEQ ID NO: 1906 - DNA, 33 bp, homo sapien
ttactgaaggatggagyatccaaatggcaccca

SEQ ID NO: 1907 - DNA, 33 bp, homo sapien
gaaaaaagaattcttcrctgtcaaattatttat

SEQ ID NO: 1908 - DNA, 33 bp, homo sapien
atacaatttccatgttsctataaaaatggggtt

SEQ ID NO: 1909 - DNA, 33 bp, homo sapien
tcactttacggtgctgycaaaaactatcactta

SEQ ID NO: 1910 - DNA, 33 bp, homo sapien
ttagatatcctctaagrgaactttcagctctaa

SEQ ID NO: 1911 - DNA, 33 bp, homo sapien
atggtcagaatgtttgytgccctccaaaattca

SEQ ID NO: 1912 - DNA, 33 bp, homo sapien
gagccttgccacgttcrgaaacggcagttgtat

SEQ ID NO: 1913 - DNA, 33 bp, homo sapien
agttggcaataaaggtwctgagcataagcatgg

SEQ ID NO: 1914 - DNA, 33 bp, homo sapien
gtaattaattcatgttscaaaggtgacttattg

SEQ ID NO: 1915 - DNA, 33 bp, homo sapien
gttcaagaatggatatrtaactttgactcatcc

SEQ ID NO: 1916 - DNA, 33 bp, homo sapien
tggttaattaaaaggakaatcaaacattttgaa

SEQ ID NO: 1917 - DNA, 33 bp, homo sapien
gagccaatctgtgcaayaggatatgtccttcag

SEQ ID NO: 1918 - DNA, 33 bp, homo sapien
gtggctgaactgatatmcagtttgtaagaaaaa

SEQ ID NO: 1919 - DNA, 33 bp, homo sapien
atatctggggagccaaygggcagtatgacaggg

SEQ ID NO: 1920 - DNA, 33 bp, homo sapien
ctctgttctgctcttawtttttacatattagaa

SEQ ID NO: 1921 - DNA, 33 bp, homo sapien
gcttattttattggccrtctctctgactgggtt

SEQ ID NO: 1922 - DNA, 33 bp, homo sapien
actaacccagtggctgyacgttgtagttctact

SEQ ID NO: 1923 - DNA, 33 bp, homo sapien
caggcagaagaattccraataatcatggagcta

SEQ ID NO: 1924 - DNA, 33 bp, homo sapien
ccaagttaaattctttytgttcctcaagactag

SEQ ID NO: 1925 - DNA, 33 bp, homo sapien
attaaatcaaaaatcamttggacttagtgtggc

SEQ ID NO: 1926 - DNA, 33 bp, homo sapien
gaaaaaaaagtatttartagcaattacgtgttt

SEQ ID NO: 1927 - DNA, 33 bp, homo sapien
ccattccagagcaaagsaaagagagggaaagag

SEQ ID NO: 1928 - DNA, 33 bp, homo sapien
tgcacccgatatcaaakaatccaaaatatcaag

SEQ ID NO: 1929 - DNA, 33 bp, homo sapien
aggcctaaaagagtcawgttgcttctggaagat

SEQ ID NO: 1930 - DNA, 33 bp, homo sapien
gaaaggtttggtttacrtgcagatgttttcaat

SEQ ID NO: 1931 - DNA, 33 bp, homo sapien
aacagaccaacaaacarcaagagctgcaactga

SEQ ID NO: 1932 - DNA, 33 bp, homo sapien
cacccttcagtcagaarctggttccccgccttg

SEQ ID NO: 1933 - DNA, 33 bp, homo sapien
atttaaaccattatcawctcttgcttcactgct

SEQ ID NO: 1934 - DNA, 33 bp, homo sapien
gttactataattggtgrttcctatcatccctct

SEQ ID NO: 1935 - DNA, 33 bp, homo sapien
gggacactaagaaattyactattcaagataaat

SEQ ID NO: 1936 - DNA, 33 bp, homo sapien
tcaatgtacagaacgaygcagttgaaggaggaa

SEQ ID NO: 1937 - DNA, 33 bp, homo sapien
atattgttccatttccyttctctactttgccct

SEQ ID NO: 1938 - DNA, 33 bp, homo sapien
cagtagccaggaagtasttacaggaagccttga

SEQ ID NO: 1939 - DNA, 33 bp, homo sapien
agatttcaacaactaargtaggtgatccttcca

SEQ ID NO: 1940 - DNA, 33 bp, homo sapien
ctgaacaagcacttaayaaaattcaacatttat

SEQ ID NO: 1941 - DNA, 33 bp, homo sapien
cagattaaaccttagartgtgaacgcctaatag

SEQ ID NO: 1942 - DNA, 33 bp, homo sapien
cttctctccatgtttcrgagtcatcgtatgcta

SEQ ID NO: 1943 - DNA, 33 bp, homo sapien
agtcatatggttgtttyctttctatttgagaga

SEQ ID NO: 1944 - DNA, 33 bp, homo sapien
ttacctgtatcttttgyagtgtttaaattttct

SEQ ID NO: 1945 - DNA, 33 bp, homo sapien
aaaacatacagtctacraggaacagtaagatac

SEQ ID NO: 1946 - DNA, 33 bp, homo sapien
aggtaggaaaaattgcyatatattctctatggt

SEQ ID NO: 1947 - DNA, 33 bp, homo sapien
tgtgtccggcataggaytgtgacaattaatgaa

SEQ ID NO: 1948 - DNA, 33 bp, homo sapien
ctgtgatctactagacrgtgcttaagcataatg

SEQ ID NO: 1949 - DNA, 33 bp, homo sapien
ggaaaaaatgtaagtgmtagataagcttaattc

SEQ ID NO: 1950 - DNA, 33 bp, homo sapien
acctatgtatatggtayaggctattgttcctag

SEQ ID NO: 1951 - DNA, 33 bp, homo sapien
cttccaggggcatcagrtaccagtaaaagacca

SEQ ID NO: 1952 - DNA, 33 bp, homo sapien
gtggcagaaactcaatraatacttgctagttga

SEQ ID NO: 1953 - DNA, 33 bp, homo sapien
gtagactgaaacatcgytaaaatgattttcaat

SEQ ID NO: 1954 - DNA, 33 bp, homo sapien
tagaacaaaaaaaaaargggaatgaggaatgaa

SEQ ID NO: 1955 - DNA, 33 bp, homo sapien
agacaaatcacattaakagagctactattcatt

SEQ ID NO: 1956 - DNA, 33 bp, homo sapien
caaatagctcccagtamaatttaagggcagaaa

SEQ ID NO: 1957 - DNA, 33 bp, homo sapien
aaaatagtatgtgtctyagaatgtaattgttag

SEQ ID NO: 1958 - DNA, 33 bp, homo sapien
tcttctggttgttctcraatggaataaatatat

SEQ ID NO: 1959 - DNA, 33 bp, homo sapien
ttgcctccctaaaattytcccaagttaaatcgc

SEQ ID NO: 1960 - DNA, 33 bp, homo sapien
ccgtggcatagttcacktgtaattacaaggaag

SEQ ID NO: 1961 - DNA, 33 bp, homo sapien
acaggagtaaagatgtmaaacagggaagccttg

SEQ ID NO: 1962 - DNA, 33 bp, homo sapien
tgatctctgtagatttwgaattaaatgatatga

SEQ ID NO: 1963 - DNA, 33 bp, homo sapien
taccttacttatgctaycttacttctctatcct

SEQ ID NO: 1964 - DNA, 33 bp, homo sapien
ttaaactctacctattwttgataaactctctca

SEQ ID NO: 1965 - DNA, 33 bp, homo sapien
gctaatacgatgaaaascaaggattcaaatcta

SEQ ID NO: 1966 - DNA, 33 bp, homo sapien
tccaggccatgtgtccygatgttccatagccct

SEQ ID NO: 1967 - DNA, 33 bp, homo sapien
tccatgagtgtcaaaamccgatgatgacattac

SEQ ID NO: 1968 - DNA, 33 bp, homo sapien
tatatgtggttgaaaaygtgttaataaagatgg

SEQ ID NO: 1969 - DNA, 33 bp, homo sapien
tgacactgaaattggtraagatacattaatact

SEQ ID NO: 1970 - DNA, 33 bp, homo sapien
ttatgttttagtttccrttctattcaatgttct

SEQ ID NO: 1971 - DNA, 33 bp, homo sapien
cagatacacatgtgaayctgggtagtccctgaa

SEQ ID NO: 1972 - DNA, 33 bp, homo sapien
caccagcttgtgagtayaaataaaatcacagag

SEQ ID NO: 1973 - DNA, 33 bp, homo sapien
ggcaaagagtcactttrcaatggagaaacctga

SEQ ID NO: 1974 - DNA, 33 bp, homo sapien
ggtcatactggattagmgtaggccttaagtcca

SEQ ID NO: 1975 - DNA, 33 bp, homo sapien
taagccccagtagagaygaaaaagtagtaagct

SEQ ID NO: 1976 - DNA, 33 bp, homo sapien
gtaaatatctttcatcyggtaaccactcatgac

SEQ ID NO: 1977 - DNA, 33 bp, homo sapien
ccattaacgataattcrtctggtagattgggta

SEQ ID NO: 1978 - DNA, 33 bp, homo sapien
ccaagggtttctgttcrggatttagctaactag

SEQ ID NO: 1979 - DNA, 33 bp, homo sapien
tgctccaattgcattgytccatagctgttctca

SEQ ID NO: 1980 - DNA, 33 bp, homo sapien
gatttctttaaagcacrttatcacagatgtaca

SEQ ID NO: 1981 - DNA, 33 bp, homo sapien
attaagaagattacacrtggtgtattgagttga

SEQ ID NO: 1982 - DNA, 33 bp, homo sapien
gattgggcccagaaggytctaagtggcaaggcc

SEQ ID NO: 1983 - DNA, 33 bp, homo sapien
taatattcactctttgrcatgtagggcaaaatt

SEQ ID NO: 1984 - DNA, 33 bp, homo sapien
aagcccgtttcaccagkataattgagcagctat

SEQ ID NO: 1985 - DNA, 33 bp, homo sapien
tattggtgttgataggyaaataaataacttatg

SEQ ID NO: 1986 - DNA, 33 bp, homo sapien
agaggttattttggctyatgcttctacaaactg

SEQ ID NO: 1987 - DNA, 33 bp, homo sapien
aacctgtgacattttayggactgctaagcattt

SEQ ID NO: 1988 - DNA, 33 bp, homo sapien
catgttttagctagagscaaacacaacaaaatg

SEQ ID NO: 1989 - DNA, 33 bp, homo sapien
ttccttgctcacttatrttataaactattgcat

SEQ ID NO: 1990 - DNA, 33 bp, homo sapien
taaaggccagcagctawccctagtcactgggac

SEQ ID NO: 1991 - DNA, 33 bp, homo sapien
aaacagggaagatatasaacagaatgcattgat

SEQ ID NO: 1992 - DNA, 33 bp, homo sapien
ctccctcaaatcctggstttgctactttctaag

SEQ ID NO: 1993 - DNA, 33 bp, homo sapien
tacgcttggccacattrcttatgtagaataact

SEQ ID NO: 1994 - DNA, 33 bp, homo sapien
tcctttatttcccaatsttatagacaatgagca

SEQ ID NO: 1995 - DNA, 33 bp, homo sapien
ctcagtattcctctttratttatctgactttca

SEQ ID NO: 1996 - DNA, 33 bp, homo sapien
ccacacatgccagatgkgtcatctcatacagga

SEQ ID NO: 1997 - DNA, 33 bp, homo sapien
tatcttccccacagggytaggatgattaagata

SEQ ID NO: 1998 - DNA, 33 bp, homo sapien
caactttcctttttctygtcacttgtagttgag

SEQ ID NO: 1999 - DNA, 33 bp, homo sapien
tgtttgctgtgggacaratcacaagactggggg

SEQ ID NO: 2000 - DNA, 33 bp, homo sapien
caggagaagatctcagygcagctcctgctgtga

SEQ ID NO: 2001 - DNA, 33 bp, homo sapien
ctctccttaaggcctakgtctaccttcatgact

SEQ ID NO: 2002 - DNA, 33 bp, homo sapien
tagcaaaagttagctcrttacagatttcacatc

SEQ ID NO: 2003 - DNA, 33 bp, homo sapien
tgcaactcacccatggraagttatggaatcttg

SEQ ID NO: 2004 - DNA, 33 bp, homo sapien
ctttgcatatagttgcrtcttgaagaaagaaga

SEQ ID NO: 2005 - DNA, 33 bp, homo sapien
gcagagtgatgcaatcrttgaccttgaaaatag

SEQ ID NO: 2006 - DNA, 33 bp, homo sapien
tgggcctggactatacratccagtttaaattat

SEQ ID NO: 2007 - DNA, 33 bp, homo sapien
cagaaactagttcactygaaaatgcaggaaacc

SEQ ID NO: 2008 - DNA, 33 bp, homo sapien
tcagaatggcgtcctcrgagagtagaaagaaca

SEQ ID NO: 2009 - DNA, 33 bp, homo sapien
gtgggattataattcayggtagctttaaattcc

SEQ ID NO: 2010 - DNA, 33 bp, homo sapien
gtcagtcaaaagatggsaactcagcattgaata

SEQ ID NO: 2011 - DNA, 33 bp, homo sapien
ttatgttaaatactgastcacaggagagggccc

SEQ ID NO: 2012 - DNA, 33 bp, homo sapien
atgctggaagcacttgkgaacagctgggccaga

SEQ ID NO: 2013 - DNA, 33 bp, homo sapien
ctttgatgccataattscttagtttggagtcat

SEQ ID NO: 2014 - DNA, 33 bp, homo sapien
caggtagtaataccaaygatggggagtggctgt

SEQ ID NO: 2015 - DNA, 33 bp, homo sapien
tgaggagtgcatagacyacaatagattttaata

SEQ ID NO: 2016 - DNA, 33 bp, homo sapien
tcatatataggtgaaawgatttgcctgagtgaa

SEQ ID NO: 2017 - DNA, 33 bp, homo sapien
cccctgtatgtccagargatataaaactattcc

SEQ ID NO: 2018 - DNA, 33 bp, homo sapien
tgttttacatgtctcarataataccatatactg

SEQ ID NO: 2019 - DNA, 33 bp, homo sapien
ccattagcttacaacckctatgagggcagagaa

SEQ ID NO: 2020 - DNA, 33 bp, homo sapien
gagggggaaaaggagaytacatgaggttttgag

SEQ ID NO: 2021 - DNA, 33 bp, homo sapien
ctaaacctcaccttagrggccataaaaaaagta

SEQ ID NO: 2022 - DNA, 33 bp, homo sapien
ttctttgcttccatccrtcaacccatttgctga

SEQ ID NO: 2023 - DNA, 33 bp, homo sapien
tatttaggcaaatgcayctctcgaatcctggaa

SEQ ID NO: 2024 - DNA, 33 bp, homo sapien
atgttttgaaagtgttygtgttttttcttagaa

SEQ ID NO: 2025 - DNA, 33 bp, homo sapien
aacaacctttcttacartagaaccatcctttct

SEQ ID NO: 2026 - DNA, 33 bp, homo sapien
agaaaacaaattcgtgmacaatgtggaacagtc

SEQ ID NO: 2027 - DNA, 33 bp, homo sapien
gattatttggatcaacyctcagaacacacaaaa

SEQ ID NO: 2028 - DNA, 33 bp, homo sapien
aatgtacaagatattcrgttcctcagccacaaa

SEQ ID NO: 2029 - DNA, 33 bp, homo sapien
gttcagggaggattaamaagcactggtctaaaa

SEQ ID NO: 2030 - DNA, 33 bp, homo sapien
gcaatttgtgttttcckctaggttgctttggga

SEQ ID NO: 2031 - DNA, 33 bp, homo sapien
aaatccatgtgcaactrtatctgcagaggaaaa

SEQ ID NO: 2032 - DNA, 33 bp, homo sapien
ttgcagatgtaaattayggacctcgagaccggg

SEQ ID NO: 2033 - DNA, 33 bp, homo sapien
tccaatcaagtgaattytagccacttattactg

SEQ ID NO: 2034 - DNA, 33 bp, homo sapien
tgattttatgtcaaagrttagatcaagcacttc

SEQ ID NO: 2035 - DNA, 33 bp, homo sapien
tcattcccttttgtagygcaaatcagtagttgg

SEQ ID NO: 2036 - DNA, 33 bp, homo sapien
gtctcatgggattcctrtaagcattgtattgga

SEQ ID NO: 2037 - DNA, 33 bp, homo sapien
ttgatcatctgccaaarcatccttagaattcat

SEQ ID NO: 2038 - DNA, 33 bp, homo sapien
ctgaggtctgataaaamgtttgttggattaatt

SEQ ID NO: 2039 - DNA, 33 bp, homo sapien
agcagctttgctctacrttcttttcaatccaag

SEQ ID NO: 2040 - DNA, 33 bp, homo sapien
tttttatttttcatacsctgctctcaaatacaa

SEQ ID NO: 2041 - DNA, 33 bp, homo sapien
tttaccaatgagaaaaygaaggcataaaaagag

SEQ ID NO: 2042 - DNA, 33 bp, homo sapien
gtatgagttcaggcaartcatctaagtccccgg

SEQ ID NO: 2043 - DNA, 33 bp, homo sapien
tactctgcaatatacgyggaatgtcttaaatgc

SEQ ID NO: 2044 - DNA, 33 bp, homo sapien
ttcctggatgtctaacyattccttgttgattct

SEQ ID NO: 2045 - DNA, 33 bp, homo sapien
aaaaaactcaaacatgrtataaacagtgaataa

SEQ ID NO: 2046 - DNA, 33 bp, homo sapien
tgagatctgactgttayggagaaaagatttagg

SEQ ID NO: 2047 - DNA, 33 bp, homo sapien
ctaatgtagctgctgaytttaaattgaagccaa

SEQ ID NO: 2048 - DNA, 33 bp, homo sapien
agaaatgttctccttcyatggttcttcactcac

SEQ ID NO: 2049 - DNA, 33 bp, homo sapien
agagttttgagttaggygagaacagtggtgtag

SEQ ID NO: 2050 - DNA, 33 bp, homo sapien
ttggagagtaacaaatkatactttaacagcaac

SEQ ID NO: 2051 - DNA, 33 bp, homo sapien
atgtgtgtatacatccrcactcgttttctgaaa

SEQ ID NO: 2052 - DNA, 33 bp, homo sapien
aacacagacacccaaayagccagttgttagtac

SEQ ID NO: 2053 - DNA, 33 bp, homo sapien
aacttagcacctgtttwtgtaaataatgtttta

SEQ ID NO: 2054 - DNA, 33 bp, homo sapien
gccaattatagctatayattgagacaaccaaaa

SEQ ID NO: 2055 - DNA, 33 bp, homo sapien
aaaaactcaaaatgacsgtgaaaggagatttca

SEQ ID NO: 2056 - DNA, 33 bp, homo sapien
gtttcctaaggctgccrtaaaaaatcaccacaa

SEQ ID NO: 2057 - DNA, 33 bp, homo sapien
gaggtcacaggtccctytgacaaactggtaaga

SEQ ID NO: 2058 - DNA, 33 bp, homo sapien
aataagcaagcacattrtatccagagatgattc

SEQ ID NO: 2059 - DNA, 33 bp, homo sapien
ttaaattacctcagcakgttcagtacttagaaa

SEQ ID NO: 2060 - DNA, 33 bp, homo sapien
ataagtaggcctgctaytagttccaattctgtc

SEQ ID NO: 2061 - DNA, 33 bp, homo sapien
accacccaccttgcccrgctgctgtttgagaga

SEQ ID NO: 2062 - DNA, 33 bp, homo sapien
ttgtctggtggacccaytgtaatcacaaggttc

SEQ ID NO: 2063 - DNA, 33 bp, homo sapien
cttggtggcagagggaraaatggctgctaaaat

SEQ ID NO: 2064 - DNA, 33 bp, homo sapien
tatcagtcagtctcatmctttcaggttgttgct

SEQ ID NO: 2065 - DNA, 33 bp, homo sapien
gactattgactgggaayaagccgagaatattgt

SEQ ID NO: 2066 - DNA, 33 bp, homo sapien
aggttcagttgcgtttytgtgatttgcagcaga

SEQ ID NO: 2067 - DNA, 33 bp, homo sapien
aggctcactatcatttrcatagcttaaaaaagg

SEQ ID NO: 2068 - DNA, 33 bp, homo sapien
attgtgaaagtatagtygtcctttaaatgtttg

SEQ ID NO: 2069 - DNA, 33 bp, homo sapien
aactcaaatacgaatcyctccttgtcagctgcc

SEQ ID NO: 2070 - DNA, 33 bp, homo sapien
ggtgattaaggatcatragattgggagattacc

SEQ ID NO: 2071 - DNA, 33 bp, homo sapien
taaactctgaagtccayatttttcttaaatcca

SEQ ID NO: 2072 - DNA, 33 bp, homo sapien
attggacaacgtgcaayataggactctgattct

SEQ ID NO: 2073 - DNA, 33 bp, homo sapien
aaagcatgcacacttgrataattagtgtttcct

SEQ ID NO: 2074 - DNA, 33 bp, homo sapien
taagtgtacaagtcaayggaatataatacagtg

SEQ ID NO: 2075 - DNA, 33 bp, homo sapien
acagtgatgtaaaattracaatgatataaccat

SEQ ID NO: 2076 - DNA, 33 bp, homo sapien
tatcaccttgaacatgygcacagaaagggcctg

SEQ ID NO: 2077 - DNA, 33 bp, homo sapien
aacactagctgcatatrtaatcctgtgaaagcc

SEQ ID NO: 2078 - DNA, 33 bp, homo sapien
gaactgggaagaatgaygccttctatatttgta

SEQ ID NO: 2079 - DNA, 33 bp, homo sapien
aaatacaatatctgccytgcaatgttgctaaat

SEQ ID NO: 2080 - DNA, 33 bp, homo sapien
ggcatggttgctctcayctgtggtcctagctac

SEQ ID NO: 2081 - DNA, 33 bp, homo sapien
cccctaaatagacactraaaaaaaatttgaaga

SEQ ID NO: 2082 - DNA, 33 bp, homo sapien
gaacatcctttcctggratctgtctgaagtgta

SEQ ID NO: 2083 - DNA, 33 bp, homo sapien
tgcaaagagctgagccsgcaagtttgcctcacc

SEQ ID NO: 2084 - DNA, 33 bp, homo sapien
ttgacacattaaatttyagtcttggcttcaact

SEQ ID NO: 2085 - DNA, 33 bp, homo sapien
agagatttcacatccakaggttaattaagccat

SEQ ID NO: 2086 - DNA, 33 bp, homo sapien
tatcatttctgcagttmttaaaagttatgttct

SEQ ID NO: 2087 - DNA, 33 bp, homo sapien
aagttaacaggctaatkcttacttgtggtattt

SEQ ID NO: 2088 - DNA, 33 bp, homo sapien
taagtagacaataacaraatcaaggcaaaagta

SEQ ID NO: 2089 - DNA, 33 bp, homo sapien
tttatctttgaaaatgycctcagctgtgccaaa

SEQ ID NO: 2090 - DNA, 33 bp, homo sapien
aaatcagactaattttktccagacctagaaacc

SEQ ID NO: 2091 - DNA, 33 bp, homo sapien
gggtattattttgatasagattacaattactat

SEQ ID NO: 2092 - DNA, 33 bp, homo sapien
ctccctttccattcccrgaggagagaaaccatt

SEQ ID NO: 2093 - DNA, 33 bp, homo sapien
atgtgtttccttacctrttgcccattaggcacc

SEQ ID NO: 2094 - DNA, 33 bp, homo sapien
ctctcttccaatcctcyaggttctcataacccc

SEQ ID NO: 2095 - DNA, 33 bp, homo sapien
catcacacctataggarctagaaaatcaaggac

SEQ ID NO: 2096 - DNA, 33 bp, homo sapien
cttattttgaagacttstttttaatcctctctt

SEQ ID NO: 2097 - DNA, 33 bp, homo sapien
gatcatgaaagttgtamatttgaagaaggtgaa

SEQ ID NO: 2098 - DNA, 33 bp, homo sapien
tagatttctgtacttgsagttgctagggcaaaa

SEQ ID NO: 2099 - DNA, 33 bp, homo sapien
aggaactggactgaaaytgaaaggaaaccccag

SEQ ID NO: 2100 - DNA, 33 bp, homo sapien
tccagattctccattcrttcttaagtgcaaaag

SEQ ID NO: 2101 - DNA, 33 bp, homo sapien
tgtaaaactgactcaaygttcccaactggatta

SEQ ID NO: 2102 - DNA, 33 bp, homo sapien
actgaaatcagaaatgwgcaggcttggtggcag

SEQ ID NO: 2103 - DNA, 33 bp, homo sapien
actggttctgtcaaaascctaacttacggcttc

SEQ ID NO: 2104 - DNA, 33 bp, homo sapien
ggcagctcatgtacacwttttttttgggttggt

SEQ ID NO: 2105 - DNA, 33 bp, homo sapien
agaagagattcctttayttattccatattttgt

SEQ ID NO: 2106 - DNA, 33 bp, homo sapien
ccaaaccaaatgtgttraggcactaggcatgca

SEQ ID NO: 2107 - DNA, 33 bp, homo sapien
gcgcatgtctaataaakggtcaaggtggagtta

SEQ ID NO: 2108 - DNA, 33 bp, homo sapien
cagaagtggtcaaaagyagaatttaaaagaacc

SEQ ID NO: 2109 - DNA, 33 bp, homo sapien
tactgattacctgtctkggatttcttgacaatt

SEQ ID NO: 2110 - DNA, 33 bp, homo sapien
aatgacttatttggagyagtgattgatgaaaaa

SEQ ID NO: 2111 - DNA, 33 bp, homo sapien
cttcctaatccactgaraatacaaaccaagact

SEQ ID NO: 2112 - DNA, 33 bp, homo sapien
gggcactaagtgagctyttaggatgtctgattc

SEQ ID NO: 2113 - DNA, 33 bp, homo sapien
aaggaaaagtttaagawcaaatgcataaggaag

SEQ ID NO: 2114 - DNA, 33 bp, homo sapien
agatctgaatgaactasggtgatggccaaatta

SEQ ID NO: 2115 - DNA, 33 bp, homo sapien
tagcttcctagaaaggrtatatgaatgcaacaa

SEQ ID NO: 2116 - DNA, 33 bp, homo sapien
aagctcaacataagtayaagtcaatttttggcc

SEQ ID NO: 2117 - DNA, 33 bp, homo sapien
acaaactttggttttcycatcagcagatgtgaa

SEQ ID NO: 2118 - DNA, 33 bp, homo sapien
cttaacacgctaacaaygtaaacggctcaacag

SEQ ID NO: 2119 - DNA, 33 bp, homo sapien
ataaatagaaagaagarattgaagatgttgaca

SEQ ID NO: 2120 - DNA, 33 bp, homo sapien
caccaatcacaggagtytatcacagttttcttc

SEQ ID NO: 2121 - DNA, 33 bp, homo sapien
atatctattattcctaygtgtttcttttatgta

SEQ ID NO: 2122 - DNA, 33 bp, homo sapien
agaggagtcctgattaytgaattgaagggagtt

SEQ ID NO: 2123 - DNA, 33 bp, homo sapien
tagtcatctttttctayaaatatgatcatagag

SEQ ID NO: 2124 - DNA, 33 bp, homo sapien
ttatagcacaactgaartattttacaacttaaa

SEQ ID NO: 2125 - DNA, 33 bp, homo sapien
ttaataacattccaccrtagttcagactatata

SEQ ID NO: 2126 - DNA, 33 bp, homo sapien
ggatgagagcagattcrttttcagaccagaata

SEQ ID NO: 2127 - DNA, 33 bp, homo sapien
gggcaatttgtggccaycatgagttatgagaga

SEQ ID NO: 2128 - DNA, 33 bp, homo sapien
agtttaactccaattaytttatgggtagtctgt

SEQ ID NO: 2129 - DNA, 33 bp, homo sapien
ggactactgtgaagctscaacagtcccaactta

SEQ ID NO: 2130 - DNA, 33 bp, homo sapien
tacaaaaatatgaaccyaatttgtggtagtatc

SEQ ID NO: 2131 - DNA, 33 bp, homo sapien
atgacccgctaacatamtcttataataatgttt

SEQ ID NO: 2132 - DNA, 33 bp, homo sapien
gtgaatgtgtccaaggwcttgggttcagatgag

SEQ ID NO: 2133 - DNA, 33 bp, homo sapien
actaaataaactaccarggaccaatactggaga

SEQ ID NO: 2134 - DNA, 33 bp, homo sapien
acttggtccttgaaacmtttatcttctgctcac

SEQ ID NO: 2135 - DNA, 33 bp, homo sapien
accttaccattcacttyctgccatcattatccc

SEQ ID NO: 2136 - DNA, 33 bp, homo sapien
aaggtataaactccacrtgttgttttctcctgg

SEQ ID NO: 2137 - DNA, 33 bp, homo sapien
tctgtaaatctgctggygggattaaagtattag

SEQ ID NO: 2138 - DNA, 33 bp, homo sapien
aggaggcaagactctayttcagtctagctcagc

SEQ ID NO: 2139 - DNA, 33 bp, homo sapien
gccagtcagactatgargccagcagcagggtgg

SEQ ID NO: 2140 - DNA, 33 bp, homo sapien
cccccagtatttcaacrtaggttctattttcca

SEQ ID NO: 2141 - DNA, 33 bp, homo sapien
ccagagcatcagggcawagaagacaggcatgga

SEQ ID NO: 2142 - DNA, 33 bp, homo sapien
aacaggttccaattctkcacaaatatgagataa

SEQ ID NO: 2143 - DNA, 33 bp, homo sapien
atctttgtgggagaacrgttactatgatgaaca

SEQ ID NO: 2144 - DNA, 33 bp, homo sapien
aaataacatgctgactytaaccaattgaatgtg

SEQ ID NO: 2145 - DNA, 33 bp, homo sapien
ggttcctgcctgccacrtgccataccactgcgg

SEQ ID NO: 2146 - DNA, 33 bp, homo sapien
ccaatatgttttccacraggcttgcaattttac

SEQ ID NO: 2147 - DNA, 33 bp, homo sapien
actgcaatctgtgcagragaaagtaactatgat

SEQ ID NO: 2148 - DNA, 33 bp, homo sapien
ttctccctctctaatgyatcaaatccatgatca

SEQ ID NO: 2149 - DNA, 33 bp, homo sapien
tataaagtgcctggtgragctacagtggaagag

SEQ ID NO: 2150 - DNA, 33 bp, homo sapien
gtggattcaggtgtgamccagtgcagtgccagc

SEQ ID NO: 2151 - DNA, 33 bp, homo sapien
aaattggcagagataarcaattaaattcagcag

SEQ ID NO: 2152 - DNA, 33 bp, homo sapien
aggccttgggccacgcrctatccaagtgatttt

SEQ ID NO: 2153 - DNA, 33 bp, homo sapien
acttgactttctccagyggcagaaatcttttag

SEQ ID NO: 2154 - DNA, 33 bp, homo sapien
gcaggcattaaggactragacaatgttgtgtac

SEQ ID NO: 2155 - DNA, 33 bp, homo sapien
caaaataaattcaaaastgtgcaaaatctatgt

SEQ ID NO: 2156 - DNA, 33 bp, homo sapien
agcagttaattggtgasaggccaaatacgaaaa

SEQ ID NO: 2157 - DNA, 33 bp, homo sapien
taaaatgtccggccgaygtttctggggtaggag

SEQ ID NO: 2158 - DNA, 33 bp, homo sapien
tacttttaaacatactrcacattcaattctgtt

SEQ ID NO: 2159 - DNA, 33 bp, homo sapien
tataaggaagacaaaascaacaacaaattaggg

SEQ ID NO: 2160 - DNA, 33 bp, homo sapien
tttcccttatcttgtcytgactaatggctggat

SEQ ID NO: 2161 - DNA, 33 bp, homo sapien
catcattaccaagctcratgaataaatgatata

SEQ ID NO: 2162 - DNA, 33 bp, homo sapien
gtattattgctcctcayaagcttaaaatccctt

SEQ ID NO: 2163 - DNA, 33 bp, homo sapien
tcattgaagaaatgggyttaaatctgcatttga

SEQ ID NO: 2164 - DNA, 33 bp, homo sapien
tgctattaatgatagcrattcacgctagagtcc

SEQ ID NO: 2165 - DNA, 33 bp, homo sapien
gacacagaggtcactaygagtcttatggacatg

SEQ ID NO: 2166 - DNA, 33 bp, homo sapien
atattttatcaagggcyatttctgtgtaagcac

SEQ ID NO: 2167 - DNA, 33 bp, homo sapien
ttttaaatattgacagmaattcaaaaaagttct

SEQ ID NO: 2168 - DNA, 33 bp, homo sapien
acttggaaattgatggyctcaaaagatagtgcc

SEQ ID NO: 2169 - DNA, 33 bp, homo sapien
gatggggagtggcatcytgacagctttccccct

SEQ ID NO: 2170 - DNA, 33 bp, homo sapien
cacaccctatgcttttyatcttcctcacatttg

SEQ ID NO: 2171 - DNA, 33 bp, homo sapien
ctgcttaactttctgawatcagattgtgtctct

SEQ ID NO: 2172 - DNA, 33 bp, homo sapien
atgaactaactgcctcrtgttctgtggcttaac

SEQ ID NO: 2173 - DNA, 33 bp, homo sapien
ttcttctatgaaatccrtaagcctccatatata

SEQ ID NO: 2174 - DNA, 33 bp, homo sapien
gctgaggcttatcaagytccttctatgagtcag

SEQ ID NO: 2175 - DNA, 33 bp, homo sapien
tggactgcaccagatargctatgctaacaatgt

SEQ ID NO: 2176 - DNA, 33 bp, homo sapien
cgagtggctggcctcasttaggattgcagtgag

SEQ ID NO: 2177 - DNA, 33 bp, homo sapien
gttctataattctagckcagagacttccagttc

SEQ ID NO: 2178 - DNA, 33 bp, homo sapien
gggatgtgattgttacwgcgggtggtgtgtgct

SEQ ID NO: 2179 - DNA, 33 bp, homo sapien
ctggtgattacaattcracacgagatttgggca

SEQ ID NO: 2180 - DNA, 33 bp, homo sapien
caataaccatggatttyattcccactgcttcct

SEQ ID NO: 2181 - DNA, 33 bp, homo sapien
atatgatcaaattttgygaagataagaataact

SEQ ID NO: 2182 - DNA, 33 bp, homo sapien
attatatttctgtgtayattttgagaaataaat

SEQ ID NO: 2183 - DNA, 33 bp, homo sapien
ttgcactcagggcaaaygtcaactccactgtac

SEQ ID NO: 2184 - DNA, 33 bp, homo sapien
agtcagttggattttgyttccattaatgtttcc

SEQ ID NO: 2185 - DNA, 33 bp, homo sapien
aaacactttttgtgacrtgtaataaatgttcaa

SEQ ID NO: 2186 - DNA, 33 bp, homo sapien
tatgaaactttactatstgaatgtgtactacct

SEQ ID NO: 2187 - DNA, 33 bp, homo sapien
tttatttcgaagttgcrtgtattgtgttaattt

SEQ ID NO: 2188 - DNA, 33 bp, homo sapien
cagtaatcttggagtgytatgtcttgttccaac

SEQ ID NO: 2189 - DNA, 33 bp, homo sapien
acctggccaggttgcartagtacctagtcttgg

SEQ ID NO: 2190 - DNA, 33 bp, homo sapien
acctggcactatccatmgcaggcttcttggcca

SEQ ID NO: 2191 - DNA, 33 bp, homo sapien
ggaaattattctcaagsctatatcccagagact

SEQ ID NO: 2192 - DNA, 33 bp, homo sapien
ctcagccacttggctcygctgtatttcctcaca

SEQ ID NO: 2193 - DNA, 33 bp, homo sapien
tgtatgcagaaatagtmaatttgacaacattaa

SEQ ID NO: 2194 - DNA, 33 bp, homo sapien
tgccaaattgaatgatrtattttcacatcctga

SEQ ID NO: 2195 - DNA, 33 bp, homo sapien
cctttggcccagatttygtttctggtgctaatc

SEQ ID NO: 2196 - DNA, 33 bp, homo sapien
ctcttaattgaacaaaytctcttgattagctta

SEQ ID NO: 2197 - DNA, 33 bp, homo sapien
taaaggttatttgaagrccaatctggcatatag

SEQ ID NO: 2198 - DNA, 33 bp, homo sapien
aaaactagtttaatgamgtatggttgcagaaaa

SEQ ID NO: 2199 - DNA, 33 bp, homo sapien
agatgagactgtgtacrttgaacttctgagctg

SEQ ID NO: 2200 - DNA, 33 bp, homo sapien
gtgagaagaagaaaatkgagtccttgctggctg

SEQ ID NO: 2201 - DNA, 33 bp, homo sapien
cttggaagtgattctcyttcacttttgctgtat

SEQ ID NO: 2202 - DNA, 33 bp, homo sapien
agtagaaaatactgcarttactgatatggatat

SEQ ID NO: 2203 - DNA, 33 bp, homo sapien
tttaagaaaggaattcragctgtacattgtctt

SEQ ID NO: 2204 - DNA, 33 bp, homo sapien
ctaagagttgctatccrtatgatcttgtaacca

SEQ ID NO: 2205 - DNA, 33 bp, homo sapien
ggcacagaggaacattktccaactctttggaat

SEQ ID NO: 2206 - DNA, 33 bp, homo sapien
atttgactgcaaactcyaccactaactagctgt

SEQ ID NO: 2207 - DNA, 33 bp, homo sapien
caatctaaacagtcccrtgagtaagaacagaaa

SEQ ID NO: 2208 - DNA, 33 bp, homo sapien
tgatgctatacaaaatscatcttttcagtcagt

SEQ ID NO: 2209 - DNA, 33 bp, homo sapien
tctttctgcggtaatarcaagtctattctacat

SEQ ID NO: 2210 - DNA, 33 bp, homo sapien
aatacttcatataatgrattgcagttcccaaaa

SEQ ID NO: 2211 - DNA, 33 bp, homo sapien
aagagatggcctgtttycagatcttctctttga

SEQ ID NO: 2212 - DNA, 33 bp, homo sapien
gctaagttgaacctgtyaaattgagttctcctc

SEQ ID NO: 2213 - DNA, 33 bp, homo sapien
caattctttctaggtcrggtccaaacaatacta

SEQ ID NO: 2214 - DNA, 33 bp, homo sapien
tatcactgacaatagcsgaaacttaccagttac

SEQ ID NO: 2215 - DNA, 33 bp, homo sapien
aaaagtcatggctagcrgcatttccctttgcct

SEQ ID NO: 2216 - DNA, 33 bp, homo sapien
ccttcttgcaataactsttgatggaaagaaatc

SEQ ID NO: 2217 - DNA, 33 bp, homo sapien
aagcaactgttttcaaygaggtttgattagttg

SEQ ID NO: 2218 - DNA, 33 bp, homo sapien
gttgattttatatatgscttcaagcttgatcca

SEQ ID NO: 2219 - DNA, 33 bp, homo sapien
ggcttcaaacactgacrttggtgctagactcca

SEQ ID NO: 2220 - DNA, 33 bp, homo sapien
aaagaggctgtgctttyataagagcaaaatgct

SEQ ID NO: 2221 - DNA, 33 bp, homo sapien
gccaatgcatttccttygtgtccaagctagtct

SEQ ID NO: 2222 - DNA, 33 bp, homo sapien
gcaacatcttcattttmgccacatgagacccat

SEQ ID NO: 2223 - DNA, 33 bp, homo sapien
gaaagagttcattgtargtaaatttttggaaag

SEQ ID NO: 2224 - DNA, 33 bp, homo sapien
agtaagatattaggctkccatatgatccagaga

SEQ ID NO: 2225 - DNA, 33 bp, homo sapien
ggatggtgaggaagcastaacacttgttccaag

SEQ ID NO: 2226 - DNA, 33 bp, homo sapien
aagtcagaccctatcastcctctactcaaaagc

SEQ ID NO: 2227 - DNA, 33 bp, homo sapien
aaaaaactggctgtccrtaattggtaaacatga

SEQ ID NO: 2228 - DNA, 33 bp, homo sapien
caaacaatgtagaagakccaggtaatagccatc

SEQ ID NO: 2229 - DNA, 33 bp, homo sapien
taatacagcagatactmtgatatccaacatgtg

SEQ ID NO: 2230 - DNA, 33 bp, homo sapien
ctccaaagagaaccagrtttctgctttctctta

SEQ ID NO: 2231 - DNA, 33 bp, homo sapien
gatttggacatttccckttaggaaccacgattc

SEQ ID NO: 2232 - DNA, 33 bp, homo sapien
agctgaacatttatcayttctacatttttatcc

SEQ ID NO: 2233 - DNA, 33 bp, homo sapien
ttctgctttagaattcrtttggctccctggctc

SEQ ID NO: 2234 - DNA, 33 bp, homo sapien
aagagttgcggcgtatyggagacgagtttaacg

SEQ ID NO: 2235 - DNA, 33 bp, homo sapien
attagaatattttcaartaactccatggtgttc

SEQ ID NO: 2236 - DNA, 33 bp, homo sapien
agattatggaaatgttytgtatttgcactatcc

SEQ ID NO: 2237 - DNA, 33 bp, homo sapien
attacagggggtaaggwtgtctcatatcagtat

SEQ ID NO: 2238 - DNA, 33 bp, homo sapien
tagtatgaacaaaaaaygtatctcattaataat

SEQ ID NO: 2239 - DNA, 33 bp, homo sapien
cattgaaaggacagtcrtttagataagaactta

SEQ ID NO: 2240 - DNA, 33 bp, homo sapien
catcctgtacagggacragaaatggaaccagcc

SEQ ID NO: 2241 - DNA, 33 bp, homo sapien
acacaattttcttttcracagtgagtgctggga

SEQ ID NO: 2242 - DNA, 33 bp, homo sapien
tgaatctgagagtcacmaacccacctgtgaatg

SEQ ID NO: 2243 - DNA, 33 bp, homo sapien
ttgactattcttttccractgaattgtctttgc

SEQ ID NO: 2244 - DNA, 33 bp, homo sapien
tttaaaattatgatttyggttagtaatgtacta

SEQ ID NO: 2245 - DNA, 33 bp, homo sapien
agctggtaacaagttaygacaaagcagcaatga

SEQ ID NO: 2246 - DNA, 33 bp, homo sapien
tgacactctgagaaccrctggtttgtttgtttg

SEQ ID NO: 2247 - DNA, 33 bp, homo sapien
cttaaagtactattcckgtattctagctactct

SEQ ID NO: 2248 - DNA, 33 bp, homo sapien
aggatccagcaggactrggtaccaaagccatga

SEQ ID NO: 2249 - DNA, 33 bp, homo sapien
aagcattttgacagagytaatcacagggtgtca

SEQ ID NO: 2250 - DNA, 33 bp, homo sapien
gctcacccacaaccacmttttcctgctctatag

SEQ ID NO: 2251 - DNA, 33 bp, homo sapien
agaaaatagagctgatsaaagaagtggaacaat

SEQ ID NO: 2252 - DNA, 33 bp, homo sapien
caaaaacttaactactratagcccactctggat

SEQ ID NO: 2253 - DNA, 33 bp, homo sapien
aaacaaggcaatcattrtgaagcttcagcccag

SEQ ID NO: 2254 - DNA, 33 bp, homo sapien
tccagttgttttctcaygactcattgttcttct

SEQ ID NO: 2255 - DNA, 33 bp, homo sapien
ccaggctaacctggttyctaacacgtctattct

SEQ ID NO: 2256 - DNA, 33 bp, homo sapien
ggatagtgggctacagkatttctgtgtcaaatt

SEQ ID NO: 2257 - DNA, 33 bp, homo sapien
attaagtttcctgtaaygccagccaggagatct

SEQ ID NO: 2258 - DNA, 33 bp, homo sapien
ttcttctcttctcatcycaggaaataatcactg

SEQ ID NO: 2259 - DNA, 33 bp, homo sapien
gtatgctttggagtggygaggttaaagtgatct

SEQ ID NO: 2260 - DNA, 33 bp, homo sapien
gaaggggtggcatgtcsaaagactcagaaattc

SEQ ID NO: 2261 - DNA, 33 bp, homo sapien
gggtagtgactttactyggatagagtgttgaga

SEQ ID NO: 2262 - DNA, 33 bp, homo sapien
attgcctcaaactctgwatatgcaatattttcc

SEQ ID NO: 2263 - DNA, 33 bp, homo sapien
tgtttaatttctacctmctcctgttacaatcat

SEQ ID NO: 2264 - DNA, 33 bp, homo sapien
ttccaaaaagttcaagyctatcatcattaaact

SEQ ID NO: 2265 - DNA, 33 bp, homo sapien
gcatttgctgggacgcrgtatgaccaggaccca

SEQ ID NO: 2266 - DNA, 33 bp, homo sapien
agctgctatccacttcyaatcttaccaattcca

SEQ ID NO: 2267 - DNA, 33 bp, homo sapien
gaactatcaaaacataygaaaacctaaataatg

SEQ ID NO: 2268 - DNA, 33 bp, homo sapien
agttccttcatgcctgwctactgcagaaccatc

SEQ ID NO: 2269 - DNA, 33 bp, homo sapien
aagacagtaaaagaagwgtaacaaaccagatgt

SEQ ID NO: 2270 - DNA, 33 bp, homo sapien
ggtgtagtgattcaagsacacatgtggccacca

SEQ ID NO: 2271 - DNA, 33 bp, homo sapien
tttcgatatggatcacrtgggtataatggggat

SEQ ID NO: 2272 - DNA, 33 bp, homo sapien
ggcgttggaatgaaacyatactctgtttgttct

SEQ ID NO: 2273 - DNA, 33 bp, homo sapien
tccagttcaatacaggrctgaaggacaaacaga

SEQ ID NO: 2274 - DNA, 33 bp, homo sapien
acacatttaactgattscttggctcaccattgc

SEQ ID NO: 2275 - DNA, 33 bp, homo sapien
cataaatgatataatgytgaattactggccacg

SEQ ID NO: 2276 - DNA, 33 bp, homo sapien
aggaactgataatagayttggcaaaaacacaaa

SEQ ID NO: 2277 - DNA, 33 bp, homo sapien
actataacacaaagcargatgtgataagtatta

SEQ ID NO: 2278 - DNA, 33 bp, homo sapien
catttactaaatcatcragagtaaaatgggagt

SEQ ID NO: 2279 - DNA, 33 bp, homo sapien
ggtgaatgttcactggwtgaattttgggtttta

SEQ ID NO: 2280 - DNA, 33 bp, homo sapien
ccctgagagtaaagatrctaaccagccagagag

SEQ ID NO: 2281 - DNA, 33 bp, homo sapien
ttaaagaatttttgacrgattttaatgaagaaa

SEQ ID NO: 2282 - DNA, 33 bp, homo sapien
taatcttctaaatatcrcttttactgcatccaa

SEQ ID NO: 2283 - DNA, 33 bp, homo sapien
tgctacaagagtacttracacatgcatgaactc

SEQ ID NO: 2284 - DNA, 33 bp, homo sapien
aggcacatgccaccatwtctggctaatctgttt

SEQ ID NO: 2285 - DNA, 33 bp, homo sapien
tcaacaatcccaacttygttccactacaggcat

SEQ ID NO: 2286 - DNA, 33 bp, homo sapien
aagtagagtgctttctrtgtacctgctgaggac

SEQ ID NO: 2287 - DNA, 33 bp, homo sapien
ctcttggtgggacgaawgaagcttgtgaaatac

SEQ ID NO: 2288 - DNA, 33 bp, homo sapien
gtatacatggaacatcrgatgaaacaatgtgtt

SEQ ID NO: 2289 - DNA, 33 bp, homo sapien
gatgagccttcagttgsgacctcagccttggac

SEQ ID NO: 2290 - DNA, 33 bp, homo sapien
ctattcttaacactttygtcactaagcacattg

SEQ ID NO: 2291 - DNA, 33 bp, homo sapien
aaaacaatgactcatayagtgagaaagtgattg

SEQ ID NO: 2292 - DNA, 33 bp, homo sapien
ttatctaagcatttggyttgtttgaagacatta

SEQ ID NO: 2293 - DNA, 33 bp, homo sapien
cttttttggacagggtygtgtgatggtttccca

SEQ ID NO: 2294 - DNA, 33 bp, homo sapien
ctgaataaaactgattkcccttattcaatctgc

SEQ ID NO: 2295 - DNA, 33 bp, homo sapien
atgtaagcccagggaamtagtaattgcagtctt

SEQ ID NO: 2296 - DNA, 33 bp, homo sapien
ttaaagatgagagctasaggcatcctttcagct

SEQ ID NO: 2297 - DNA, 33 bp, homo sapien
gtctctggagtcccagygcggcaggaaaatgga

SEQ ID NO: 2298 - DNA, 33 bp, homo sapien
ggataaggcccattggyaagggaagaatgaagg

SEQ ID NO: 2299 - DNA, 33 bp, homo sapien
acacggacaaactttasagaagactagtaacat

SEQ ID NO: 2300 - DNA, 33 bp, homo sapien
tgaaaaactaagatccmtatgccaaatctggaa

SEQ ID NO: 2301 - DNA, 33 bp, homo sapien
aatgtttggttattttytcatggcatgacaatg

SEQ ID NO: 2302 - DNA, 33 bp, homo sapien
tgtctgagtgattattmtttatttgctaataat

SEQ ID NO: 2303 - DNA, 33 bp, homo sapien
acagaccaagtgattcyaattctttcccattat

SEQ ID NO: 2304 - DNA, 33 bp, homo sapien
ctgatatgtaccattgyaacttggaaggaattc

SEQ ID NO: 2305 - DNA, 33 bp, homo sapien
ggagatctcatccttgkctgccttctcttgcct

SEQ ID NO: 2306 - DNA, 33 bp, homo sapien
tgtaaacgtggccccartgcaagggtgctttat

SEQ ID NO: 2307 - DNA, 33 bp, homo sapien
catagaaaaagtgagtyagtgagacatatttga

SEQ ID NO: 2308 - DNA, 33 bp, homo sapien
agttgcagtttaatcaraaatttacttaataga

SEQ ID NO: 2309 - DNA, 33 bp, homo sapien
tcctggtaaacatacarctgaggtgatggaact

SEQ ID NO: 2310 - DNA, 33 bp, homo sapien
atgtagccaacgaattrtgtcagaagcagagag

SEQ ID NO: 2311 - DNA, 33 bp, homo sapien
tcataccctgcaagggrtccattttcaggtagt

SEQ ID NO: 2312 - DNA, 33 bp, homo sapien
gaaaggaccaccagacrtgtgaggaaatctaac

SEQ ID NO: 2313 - DNA, 33 bp, homo sapien
ctctccagcacccattkcctccttactcaagca

SEQ ID NO: 2314 - DNA, 33 bp, homo sapien
tagcctgtaccttttamatcaaaactcagggaa

SEQ ID NO: 2315 - DNA, 33 bp, homo sapien
aggcactttttctcaaygtatcaataactttgc

SEQ ID NO: 2316 - DNA, 33 bp, homo sapien
gataagggaatgcttgytcatatggaaagtctg

SEQ ID NO: 2317 - DNA, 33 bp, homo sapien
cctcaaaagttccaagrgagtgtaaaagctttt

SEQ ID NO: 2318 - DNA, 33 bp, homo sapien
tactgggttaccaacargagcaaaagagaaaga

SEQ ID NO: 2319 - DNA, 33 bp, homo sapien
cactattataaaatgaygacatattcaatgctg

SEQ ID NO: 2320 - DNA, 33 bp, homo sapien
catttcatttcttgtgrcacctaacttttcagc

SEQ ID NO: 2321 - DNA, 33 bp, homo sapien
aatcaccagctagtttyacctatacccacccaa

SEQ ID NO: 2322 - DNA, 33 bp, homo sapien
cctgtaaacatttctgycattacattagtcaac

SEQ ID NO: 2323 - DNA, 33 bp, homo sapien
tatgctttcaaagtaawacactgatatatcatt

SEQ ID NO: 2324 - DNA, 33 bp, homo sapien
ggaagatcatacaggcrtacacacaggagacca

SEQ ID NO: 2325 - DNA, 33 bp, homo sapien
tgctactcctatagaayataaacccatgcattt

SEQ ID NO: 2326 - DNA, 33 bp, homo sapien
ataagaacctagatgcraaagtgtccagaatta

SEQ ID NO: 2327 - DNA, 33 bp, homo sapien
catagcagactctgtcrgtgccttgccctatcc

SEQ ID NO: 2328 - DNA, 33 bp, homo sapien
aaaaaacaagcaaccamaaaagcttctcaaata

SEQ ID NO: 2329 - DNA, 33 bp, homo sapien
gacctcctctgacactrttttatcaaggagagg

SEQ ID NO: 2330 - DNA, 33 bp, homo sapien
gactacctcttctctgwgcttagaattgcattt

SEQ ID NO: 2331 - DNA, 33 bp, homo sapien
aagagatggaaggaaaytttttgcaagtggcag

SEQ ID NO: 2332 - DNA, 33 bp, homo sapien
cagtttggaagtcacakaatgtcatttctattg

SEQ ID NO: 2333 - DNA, 33 bp, homo sapien
tgaagaaacgttttctrtatttgcaccaacacc

SEQ ID NO: 2334 - DNA, 33 bp, homo sapien
tggacctggcctcttcwtgaattgatcgatgct

SEQ ID NO: 2335 - DNA, 33 bp, homo sapien
agctcagctacagtgcragctaaaaacatactc

SEQ ID NO: 2336 - DNA, 33 bp, homo sapien
cctgaacttaggcaggytatcccaagaaaaagc

SEQ ID NO: 2337 - DNA, 33 bp, homo sapien
catccttatgtctcttsctcttttctgatttcc

SEQ ID NO: 2338 - DNA, 33 bp, homo sapien
ttaaaatgtaccttggwggagttttcgtcatgt

SEQ ID NO: 2339 - DNA, 33 bp, homo sapien
cagttagaagataactrgcagtgttcctggaag

SEQ ID NO: 2340 - DNA, 33 bp, homo sapien
ccattctgggctgattrttctcaaagcccactg

SEQ ID NO: 2341 - DNA, 33 bp, homo sapien
atcagccaatacgtgtsaggattcatctggaac

SEQ ID NO: 2342 - DNA, 33 bp, homo sapien
tttgactgacatcattraaaaattagctattcg

SEQ ID NO: 2343 - DNA, 33 bp, homo sapien
acacacactagtataamgttgtacaggccactt

SEQ ID NO: 2344 - DNA, 33 bp, homo sapien
gacagataaagcatagygaaggatggggaagtg

SEQ ID NO: 2345 - DNA, 33 bp, homo sapien
aagtcccaaatctgctrtaaagcaaagcctccc

SEQ ID NO: 2346 - DNA, 33 bp, homo sapien
aggacaggtagtcacawttgctaggggtctata

SEQ ID NO: 2347 - DNA, 33 bp, homo sapien
tactcctaaatagttaygaaaaacagaagtcct

SEQ ID NO: 2348 - DNA, 33 bp, homo sapien
acccagaaaatagtgaraaatgaaaatcatgtt

SEQ ID NO: 2349 - DNA, 33 bp, homo sapien
agaggaagagctgtcargttaattaatctatct

SEQ ID NO: 2350 - DNA, 33 bp, homo sapien
ttgaatacctgtcatcytagagaaaaaacatag

SEQ ID NO: 2351 - DNA, 33 bp, homo sapien
cagccagtttattcacrtgtaatctcgtaatta

SEQ ID NO: 2352 - DNA, 33 bp, homo sapien
agattcatggattccartaaaacaaatcacctt

SEQ ID NO: 2353 - DNA, 33 bp, homo sapien
gtaatatgcagagtttyacaacataaatgacaa

SEQ ID NO: 2354 - DNA, 33 bp, homo sapien
tttccctccagtcttcrcctccatcttcacatg

SEQ ID NO: 2355 - DNA, 33 bp, homo sapien
gagagtctctttttacraactgtgcttatccca

SEQ ID NO: 2356 - DNA, 33 bp, homo sapien
gccagaataaagtcagyttgtgaggtaaaaaga

SEQ ID NO: 2357 - DNA, 33 bp, homo sapien
cacagctaaaaagcgargaataaggcaccactc

SEQ ID NO: 2358 - DNA, 33 bp, homo sapien
tctattttttcatttaygttgaatgcaatgtgc

SEQ ID NO: 2359 - DNA, 33 bp, homo sapien
gcacgcagttttagaascctcaagaaataaaat

SEQ ID NO: 2360 - DNA, 33 bp, homo sapien
ttaccaggttgttttgrtacttaagtgtgataa

SEQ ID NO: 2361 - DNA, 33 bp, homo sapien
acaaagctgaaactacyatctagccctttatag

SEQ ID NO: 2362 - DNA, 33 bp, homo sapien
catactcttcttcacarctgttggaccgttacc

SEQ ID NO: 2363 - DNA, 33 bp, homo sapien
cttgagagtaatataayattgtttgtgacactc

SEQ ID NO: 2364 - DNA, 33 bp, homo sapien
ttataagattaattacractcctggcccactaa

SEQ ID NO: 2365 - DNA, 33 bp, homo sapien
aggtgagctgccaaggytacatcattttgtggg

SEQ ID NO: 2366 - DNA, 33 bp, homo sapien
tctgtctgtgattgacrcttccttacaactgac

SEQ ID NO: 2367 - DNA, 33 bp, homo sapien
actatttgcttggcctyggaacccaaaggtact

SEQ ID NO: 2368 - DNA, 33 bp, homo sapien
aaaagtgaagtatatcragcagaaggaacctag

SEQ ID NO: 2369 - DNA, 33 bp, homo sapien
aaaatagtcagtgccarttgaaacacatatacc

SEQ ID NO: 2370 - DNA, 33 bp, homo sapien
tcacttgatgcctttcyattgctttctccttct

SEQ ID NO: 2371 - DNA, 33 bp, homo sapien
tttctgtgtatttaaaygtttccattattattt

SEQ ID NO: 2372 - DNA, 33 bp, homo sapien
tattctacactcacttscagctctaggcaacca

SEQ ID NO: 2373 - DNA, 33 bp, homo sapien
gtgtggcttaggttctrgtggtacatggaagca

SEQ ID NO: 2374 - DNA, 33 bp, homo sapien
aatcattatcaaagctktatgaagtaagactgt

SEQ ID NO: 2375 - DNA, 33 bp, homo sapien
attaagccaaattttgmacataaagctcattaa

SEQ ID NO: 2376 - DNA, 33 bp, homo sapien
ttgtgtggtttacattkgtagcttaatcaaggt

SEQ ID NO: 2377 - DNA, 33 bp, homo sapien
tgagggaatatgaaaargccacttgggtctaat

SEQ ID NO: 2378 - DNA, 33 bp, homo sapien
ttactaaagaagagtcrggtaaatataaatctg

SEQ ID NO: 2379 - DNA, 33 bp, homo sapien
tttaggagtggacttayagcgcaatcgacttaa

SEQ ID NO: 2380 - DNA, 33 bp, homo sapien
gtgattattccagaagyactcataatgggctta

SEQ ID NO: 2381 - DNA, 33 bp, homo sapien
agagtaattcatcattrccaaattccaggcatg

SEQ ID NO: 2382 - DNA, 33 bp, homo sapien
aggcaaactgacttgartacttctgagcatcta

SEQ ID NO: 2383 - DNA, 33 bp, homo sapien
acaggcgagattgggckcattcctactcctgac

SEQ ID NO: 2384 - DNA, 33 bp, homo sapien
acttctctctgtgccaraactttttgtaaaaca

SEQ ID NO: 2385 - DNA, 33 bp, homo sapien
gctaagaggaaggatcractgtgaatggcaaaa

SEQ ID NO: 2386 - DNA, 33 bp, homo sapien
ccagaatttctcccacrtgattaagctgttgtc

SEQ ID NO: 2387 - DNA, 33 bp, homo sapien
taatgggtgttgtacamatggtagttcttattt

SEQ ID NO: 2388 - DNA, 33 bp, homo sapien
ggtacattgcacatggyggtgatcaagccagac

SEQ ID NO: 2389 - DNA, 33 bp, homo sapien
cttttagtatgccttcwaattttttcttgattg

SEQ ID NO: 2390 - DNA, 33 bp, homo sapien
ggcacattgatttgtgyatctgtaaaatggaga

SEQ ID NO: 2391 - DNA, 33 bp, homo sapien
ctaaacagcgagccacrcctggatcacagtagc

SEQ ID NO: 2392 - DNA, 33 bp, homo sapien
acaactaaaatttagcycacattgccaagtcag

SEQ ID NO: 2393 - DNA, 33 bp, homo sapien
actttttggcttaagcrtatatatgactcccaa

SEQ ID NO: 2394 - DNA, 33 bp, homo sapien
tacaaaatccacttgcracaaaaactgtatttt

SEQ ID NO: 2395 - DNA, 33 bp, homo sapien
aaggacatttcaggcaragaaagtaggttaacc

SEQ ID NO: 2396 - DNA, 33 bp, homo sapien
tgaaatccaaggctccyattctgagcatctcac

SEQ ID NO: 2397 - DNA, 33 bp, homo sapien
tggaaggcagctgtggyctgataaaggcaaatg

SEQ ID NO: 2398 - DNA, 33 bp, homo sapien
cagtagacttcagtgcygattttctgactctaa

SEQ ID NO: 2399 - DNA, 33 bp, homo sapien
gtggcaggacaatatawgcaggcaacttggctc

SEQ ID NO: 2400 - DNA, 33 bp, homo sapien
aaaattcacctgctggmtaattgtaacatagag

SEQ ID NO: 2401 - DNA, 33 bp, homo sapien
gctgtaactctggatgwctgatatgggttattt

SEQ ID NO: 2402 - DNA, 33 bp, homo sapien
agagggtcgtgattccsagcaataaaaaggcct

SEQ ID NO: 2403 - DNA, 33 bp, homo sapien
aagcatacaacataggrcaagagtagagaaaca

SEQ ID NO: 2404 - DNA, 33 bp, homo sapien
aggatgcagagtacaargcacatccttcttgga

SEQ ID NO: 2405 - DNA, 33 bp, homo sapien
acacagtgaggctgaayaactaacttgccaagg

SEQ ID NO: 2406 - DNA, 33 bp, homo sapien
tccaccatggtaagacrtgcctacttctccttt

SEQ ID NO: 2407 - DNA, 33 bp, homo sapien
tcatgcatataaggagwtggtagtcattttcat

SEQ ID NO: 2408 - DNA, 33 bp, homo sapien
gctgaaggcaagacctyaactgcttcattcacc

SEQ ID NO: 2409 - DNA, 33 bp, homo sapien
ctgaattatctcttttygcatctctgccctacc

SEQ ID NO: 2410 - DNA, 33 bp, homo sapien
attggaccaagagtacmaagttctccatgaacc

SEQ ID NO: 2411 - DNA, 33 bp, homo sapien
gaaagaatgagcagaartaggagacctggggtg

SEQ ID NO: 2412 - DNA, 33 bp, homo sapien
ccaccatgtgggcaagsccgcctagatactgaa

SEQ ID NO: 2413 - DNA, 33 bp, homo sapien
tacgcatttgaccagcwtccagatcaagaaatt

SEQ ID NO: 2414 - DNA, 33 bp, homo sapien
tactgcctctgatttaraatcctgcttctgcaa

SEQ ID NO: 2415 - DNA, 33 bp, homo sapien
tttaaaacaaaagtccrgtcaagtcacttgtgt

SEQ ID NO: 2416 - DNA, 33 bp, homo sapien
ccttgaactgttgaccwcacattttcactctgc

SEQ ID NO: 2417 - DNA, 33 bp, homo sapien
accatgagtgcctgaayaaaatggaattctgca

SEQ ID NO: 2418 - DNA, 33 bp, homo sapien
gctgctccacaatgaaygtgtccttctgcttct

SEQ ID NO: 2419 - DNA, 33 bp, homo sapien
ttactgtgccgtgcctrtttgtctataccagct

SEQ ID NO: 2420 - DNA, 33 bp, homo sapien
ttaaagatgggctgctygaaccttgtatgtccc

SEQ ID NO: 2421 - DNA, 33 bp, homo sapien
agggaagcaggtaattytgaagcaagtaatact

SEQ ID NO: 2422 - DNA, 33 bp, homo sapien
gaaatggggctcttttstaagtgcatgtgatac

SEQ ID NO: 2423 - DNA, 33 bp, homo sapien
agaatgttaaaagtcarccgtttactggcaagg

SEQ ID NO: 2424 - DNA, 33 bp, homo sapien
tatgattattcacagtkaaatgctgacaggccc

SEQ ID NO: 2425 - DNA, 33 bp, homo sapien
agggtttgtggttaaakgtgaagatgtggttga

SEQ ID NO: 2426 - DNA, 33 bp, homo sapien
tcaagtagatgcagaartgagagaggaacatgg

SEQ ID NO: 2427 - DNA, 33 bp, homo sapien
atcactaaacataaaaygatacacaaaccaagt

SEQ ID NO: 2428 - DNA, 33 bp, homo sapien
cacaaggtgtttttgcrtagcttgtcccatttg

SEQ ID NO: 2429 - DNA, 33 bp, homo sapien
caggtgtttttacttayttattgaactttgtag

SEQ ID NO: 2430 - DNA, 33 bp, homo sapien
aaatattttagttatgyaatgctaccacacatc

SEQ ID NO: 2431 - DNA, 33 bp, homo sapien
tctgaggttaaactctkttaatatgtttacaaa

SEQ ID NO: 2432 - DNA, 33 bp, homo sapien
gcctcagtcatttgctrttctcattgcacatcc

SEQ ID NO: 2433 - DNA, 33 bp, homo sapien
aaacctgctccaccagytcatgttgcctctcag

SEQ ID NO: 2434 - DNA, 33 bp, homo sapien
ttagcacctttcaactmtgatattgcctttggc

SEQ ID NO: 2435 - DNA, 33 bp, homo sapien
cactctcaccttacttkcataggcactttatat

SEQ ID NO: 2436 - DNA, 33 bp, homo sapien
tttggccatggagatamatttgcaatcaccagc

SEQ ID NO: 2437 - DNA, 33 bp, homo sapien
tgacaggaagctgaacraattgagaacatgttg

SEQ ID NO: 2438 - DNA, 33 bp, homo sapien
tgctacattgcagtggrtgagaaataaatggaa

SEQ ID NO: 2439 - DNA, 33 bp, homo sapien
atgttaggctacatggmagatggaattaaggtt

SEQ ID NO: 2440 - DNA, 33 bp, homo sapien
atcatccaggaataaamagatttagagtcagac

SEQ ID NO: 2441 - DNA, 33 bp, homo sapien
gctgtccccttgccagygaaaacttggggctga

SEQ ID NO: 2442 - DNA, 33 bp, homo sapien
cccttctctctcatgtwtgaacaaatcaaatgg

SEQ ID NO: 2443 - DNA, 33 bp, homo sapien
aaactatggaagaggtmattgccccaccagata

SEQ ID NO: 2444 - DNA, 33 bp, homo sapien
ttgtcttttcactactmcacagtgcatcttggg

SEQ ID NO: 2445 - DNA, 33 bp, homo sapien
ccactcattatgtccaygttgagtacccccatc

SEQ ID NO: 2446 - DNA, 33 bp, homo sapien
tccttttgtcaagagayacttacaagatgacca

SEQ ID NO: 2447 - DNA, 33 bp, homo sapien
tctctctctgctctgtsaagcttccaaaccgtt

SEQ ID NO: 2448 - DNA, 33 bp, homo sapien
tgaatgagaagacggamtcagcaggtatttttg

SEQ ID NO: 2449 - DNA, 33 bp, homo sapien
ctggagtatagatccaygtctctgttctcctag

SEQ ID NO: 2450 - DNA, 33 bp, homo sapien
accattttctcagctcstctttgacaggagttg

SEQ ID NO: 2451 - DNA, 33 bp, homo sapien
gtctaagatgaaacttycaccctacagatgggg

SEQ ID NO: 2452 - DNA, 33 bp, homo sapien
caatgtgtaaaagacaktattttcaacaagcca

SEQ ID NO: 2453 - DNA, 33 bp, homo sapien
ctattacttctgtaacmaattgccagaaactta

SEQ ID NO: 2454 - DNA, 33 bp, homo sapien
gatgtaaggagacagayttgccctactctctgt

SEQ ID NO: 2455 - DNA, 33 bp, homo sapien
cttgtactgtcaccacyagataacaacaaacgg

SEQ ID NO: 2456 - DNA, 33 bp, homo sapien
ttaacctttgtcagtcrtcacctttgtcaactc

SEQ ID NO: 2457 - DNA, 33 bp, homo sapien
aactggacctctcacaygttgctggtgcaaatg

SEQ ID NO: 2458 - DNA, 33 bp, homo sapien
gtagattgccaggtgarcaccacagccaagaaa

SEQ ID NO: 2459 - DNA, 33 bp, homo sapien
tttccctaagtggtaaratcttgatttctttgt

SEQ ID NO: 2460 - DNA, 33 bp, homo sapien
tggccaatctagggtgstatatgcttaggatag

SEQ ID NO: 2461 - DNA, 33 bp, homo sapien
cagaggctatgtatcasacagtgcaaacataga

SEQ ID NO: 2462 - DNA, 33 bp, homo sapien
acccatacaccagaatrttatttagcaataaga

SEQ ID NO: 2463 - DNA, 33 bp, homo sapien
ccttctctctcggcagrtgtttactttgatttt

SEQ ID NO: 2464 - DNA, 33 bp, homo sapien
gtaaaactctttttccmgtggactcaagtacat

SEQ ID NO: 2465 - DNA, 33 bp, homo sapien
actgtgtgtaacttttygggttggcatttttca

SEQ ID NO: 2466 - DNA, 33 bp, homo sapien
agcagccacctgctttstgtcattatagataaa

SEQ ID NO: 2467 - DNA, 33 bp, homo sapien
tatgagtcccaacaagrtaagagagaaaaagtg

SEQ ID NO: 2468 - DNA, 33 bp, homo sapien
acttttcagttacattracggctcaaagtttga

SEQ ID NO: 2469 - DNA, 33 bp, homo sapien
tattatatacaaatggrtgtcttttacagcaat

SEQ ID NO: 2470 - DNA, 33 bp, homo sapien
atatctgttcatcagcrtattctgtaaagatag

SEQ ID NO: 2471 - DNA, 33 bp, homo sapien
cccccttttcgtgggaygagagcagagggagat

SEQ ID NO: 2472 - DNA, 33 bp, homo sapien
cagcatcagagaatcartgtattccttttgatt

SEQ ID NO: 2473 - DNA, 33 bp, homo sapien
tctaggcaagattttgrtgaccaggtagtataa

SEQ ID NO: 2474 - DNA, 33 bp, homo sapien
aagtacttctagacagytgctttttacaaataa

SEQ ID NO: 2475 - DNA, 33 bp, homo sapien
ctattggcgtaacatayatactattgattaatg

SEQ ID NO: 2476 - DNA, 33 bp, homo sapien
gaaatgtccatgtgacwtttgtgggtcagcaga

SEQ ID NO: 2477 - DNA, 33 bp, homo sapien
agaggttacattgaccmagttagaaagctaaaa

SEQ ID NO: 2478 - DNA, 33 bp, homo sapien
ctctttggtttcaagamcattgaatgcttaaaa

SEQ ID NO: 2479 - DNA, 33 bp, homo sapien
gacgtcccatgacacasctattgatatgtggca

SEQ ID NO: 2480 - DNA, 33 bp, homo sapien
ttcttctggtgctaggygagatcaatattttga

SEQ ID NO: 2481 - DNA, 33 bp, homo sapien
ttgagagagagccagarggctagcatggttgga

SEQ ID NO: 2482 - DNA, 33 bp, homo sapien
acctaggaaccgatctstcatccccaactacca

SEQ ID NO: 2483 - DNA, 33 bp, homo sapien
cagctgtttctcctagrcatcatggttactttc

SEQ ID NO: 2484 - DNA, 33 bp, homo sapien
ttcccaggctactcccrgccaatgactgagatc

SEQ ID NO: 2485 - DNA, 33 bp, homo sapien
gtggaaaatctgtacartgtgttacccaaatct

SEQ ID NO: 2486 - DNA, 33 bp, homo sapien
tccaggacccattcccrctcatcatgtgaaagt

SEQ ID NO: 2487 - DNA, 33 bp, homo sapien
tgctgggttccatttasaaagacaaagagcctc

SEQ ID NO: 2488 - DNA, 33 bp, homo sapien
gtagtgttttcccattygtattgcttatcataa

SEQ ID NO: 2489 - DNA, 33 bp, homo sapien
atttttgattgtcacarcttaggagatgcctct

SEQ ID NO: 2490 - DNA, 33 bp, homo sapien
gacctttcagagagagrgtattcaaaatagctg

SEQ ID NO: 2491 - DNA, 33 bp, homo sapien
ttttgctctctggtccmtgatattgatagtagc

SEQ ID NO: 2492 - DNA, 33 bp, homo sapien
tgttatgggcatagacyctgcctagcactggag

SEQ ID NO: 2493 - DNA, 33 bp, homo sapien
acattgagcagtcaagrgaaaaaatgttattta

SEQ ID NO: 2494 - DNA, 33 bp, homo sapien
tgtcttgtactccactkcattcccagtacctgg

SEQ ID NO: 2495 - DNA, 33 bp, homo sapien
gagtggcatgtcgaaarctgagaaaggccaaaa

SEQ ID NO: 2496 - DNA, 33 bp, homo sapien
tgagccttcttatttawcttatttggtagctgg

SEQ ID NO: 2497 - DNA, 33 bp, homo sapien
ttcctaattggcatacyttttattttgttttct

SEQ ID NO: 2498 - DNA, 33 bp, homo sapien
ttatttgactttctagyagtagcatagtaaaag

SEQ ID NO: 2499 - DNA, 33 bp, homo sapien
ctcattttagccttacrgaactcctatggggct

SEQ ID NO: 2500 - DNA, 33 bp, homo sapien
caaatgaatccaaaacwagactcaagctataat

SEQ ID NO: 2501 - DNA, 33 bp, homo sapien
ttcagagaaaaaccttsgatttatgtccatttc

SEQ ID NO: 2502 - DNA, 33 bp, homo sapien
tcaatttatataaatgmgaacacactgagcatg

SEQ ID NO: 2503 - DNA, 33 bp, homo sapien
caaatgttcctgcttcrtgccactagctcgccc

SEQ ID NO: 2504 - DNA, 33 bp, homo sapien
ctcaaagggatattaaycaagacccagcacaac

SEQ ID NO: 2505 - DNA, 33 bp, homo sapien
tttctttgacctatcarttgaggccatgaggcc

SEQ ID NO: 2506 - DNA, 33 bp, homo sapien
gcacatatttgtttttwgtttctcaggctgtgc

SEQ ID NO: 2507 - DNA, 33 bp, homo sapien
taagacagcaaacatgwtctattcccctgacca

SEQ ID NO: 2508 - DNA, 33 bp, homo sapien
gcatttggctttcattrcacagtagctcttttt

SEQ ID NO: 2509 - DNA, 33 bp, homo sapien
caacagtatcccgtgcyttctggaggtaataga

SEQ ID NO: 2510 - DNA, 33 bp, homo sapien
gtgggtagaagacaggratgctgctatatatcc

SEQ ID NO: 2511 - DNA, 33 bp, homo sapien
gtttgggaacaagctgrctcttggtaagcacat

SEQ ID NO: 2512 - DNA, 33 bp, homo sapien
aatagagagaataacakttttcattcttcatgc

SEQ ID NO: 2513 - DNA, 33 bp, homo sapien
ccataaaacgaaagtgwgatgtgaaatcgcaag

SEQ ID NO: 2514 - DNA, 33 bp, homo sapien
aaagaacgtggcttaaygaacctcatatactgt

SEQ ID NO: 2515 - DNA, 33 bp, homo sapien
ggtaaagattaaagagktgaggatggctgaggt

SEQ ID NO: 2516 - DNA, 33 bp, homo sapien
attctgctctatccacwatgacctactttctgt

SEQ ID NO: 2517 - DNA, 33 bp, homo sapien
tctctcttataaggaamcttgtaattgctttga

SEQ ID NO: 2518 - DNA, 33 bp, homo sapien
aacctctgaagccaagwgggctaacaggaaaac

SEQ ID NO: 2519 - DNA, 33 bp, homo sapien
tgacctttggaaagtgrtgtcttgactggaaac

SEQ ID NO: 2520 - DNA, 33 bp, homo sapien
ccttgatattttgagtsaaaaagtaacttcggt

SEQ ID NO: 2521 - DNA, 33 bp, homo sapien
cattgcttatgcatcaytcatctaaaagggctg

SEQ ID NO: 2522 - DNA, 33 bp, homo sapien
gtccaataaaaccacarcaaacagctttacttc

SEQ ID NO: 2523 - DNA, 33 bp, homo sapien
ctgaaagcatcccttaygttcttttagcaattt

SEQ ID NO: 2524 - DNA, 33 bp, homo sapien
aaaaaacccaacatatrgtaattaaggtaatag

SEQ ID NO: 2525 - DNA, 33 bp, homo sapien
ttgtgattgtttttgamctgggtggtggtagga

SEQ ID NO: 2526 - DNA, 33 bp, homo sapien
tgttcaacgaataaatrgatggatctttgactg

SEQ ID NO: 2527 - DNA, 33 bp, homo sapien
ggtggttagagcacagsatgaaggaagcagggt

SEQ ID NO: 2528 - DNA, 33 bp, homo sapien
ttcaaaggcttgcttgyagcttcccaggtgtat

SEQ ID NO: 2529 - DNA, 33 bp, homo sapien
cccaagtcaagcacttycccttggtgtcaaaca

SEQ ID NO: 2530 - DNA, 33 bp, homo sapien
aggtataaagaatctcygtgacattggctatct

SEQ ID NO: 2531 - DNA, 33 bp, homo sapien
taactttgcacctagargaattagaaaaaaaaa

SEQ ID NO: 2532 - DNA, 33 bp, homo sapien
caaattctgagccataygctttaacagggaaaa

SEQ ID NO: 2533 - DNA, 33 bp, homo sapien
atcactaagaaaaatcygtagactgtgagaata

SEQ ID NO: 2534 - DNA, 33 bp, homo sapien
caggaaggcagaaaaarcaaagctggaaaacag

SEQ ID NO: 2535 - DNA, 33 bp, homo sapien
ttcaaaattatctgcaygatggaaacgtctacg

SEQ ID NO: 2536 - DNA, 33 bp, homo sapien
agccaggactagaaccrtcactagaaacaaaat

SEQ ID NO: 2537 - DNA, 33 bp, homo sapien
agaccacttggctttcygatagcatgggaaatg

SEQ ID NO: 2538 - DNA, 33 bp, homo sapien
ggttgaaagtcattttsttcctgctgtttttct

SEQ ID NO: 2539 - DNA, 33 bp, homo sapien
catcatatagaagaggwaaagaatgtaagtggg

SEQ ID NO: 2540 - DNA, 33 bp, homo sapien
ctcagtttacagttggytaaatatggcatttgt

SEQ ID NO: 2541 - DNA, 33 bp, homo sapien
acataatttaaatgagkatctgattccaaaaca

SEQ ID NO: 2542 - DNA, 33 bp, homo sapien
tttccttgctttctttyctgtattgattattta

SEQ ID NO: 2543 - DNA, 33 bp, homo sapien
tatccatcagttggagrcattaacagcaaaaat

SEQ ID NO: 2544 - DNA, 33 bp, homo sapien
ggccttgggcatccacygggagcttttctcccc

SEQ ID NO: 2545 - DNA, 33 bp, homo sapien
ggagtctttctcattasagggttagctaaacat

SEQ ID NO: 2546 - DNA, 33 bp, homo sapien
ggtcaaatctcccgggyctacgcagcgctgggt

SEQ ID NO: 2547 - DNA, 33 bp, homo sapien
cttatctggatcaacaygtgagattagctacct

SEQ ID NO: 2548 - DNA, 33 bp, homo sapien
cactgacagtattagayagaccatcaaggcaga

SEQ ID NO: 2549 - DNA, 33 bp, homo sapien
ttgaaagtgacggtagraaaattataatgtctt

SEQ ID NO: 2550 - DNA, 33 bp, homo sapien
tctaccaattatgaaarcctgtgattacataat

SEQ ID NO: 2551 - DNA, 33 bp, homo sapien
tttctcatcgagttctygtcatgagcccataat

SEQ ID NO: 2552 - DNA, 33 bp, homo sapien
ccaccagttttatccaygctttactgcacacag

SEQ ID NO: 2553 - DNA, 33 bp, homo sapien
aatgtgtaagcagattrtcatcatcagaatgaa

SEQ ID NO: 2554 - DNA, 33 bp, homo sapien
ggtactgtctaacacayggcagctgcttacaaa

SEQ ID NO: 2555 - DNA, 33 bp, homo sapien
gagctaatttctatccrtctttgcttcaaggtg

SEQ ID NO: 2556 - DNA, 33 bp, homo sapien
gcaccaaggtcaaagtwtgtctcctcatagctt

SEQ ID NO: 2557 - DNA, 33 bp, homo sapien
aagaaatgtatgtgtartaattcatgtatacaa

SEQ ID NO: 2558 - DNA, 33 bp, homo sapien
ctgcatgcatacttatwtggccaatagcgttta

SEQ ID NO: 2559 - DNA, 33 bp, homo sapien
agcaagccaattcacayggcaaaacctagaaaa

SEQ ID NO: 2560 - DNA, 33 bp, homo sapien
ccctgtaatagatgctmataaacatttgggtaa

SEQ ID NO: 2561 - DNA, 33 bp, homo sapien
taactttcttactgggrctgtgaaaaagaaaca

SEQ ID NO: 2562 - DNA, 33 bp, homo sapien
ttgctcagctgtaaaarcaccttctctgctatc

SEQ ID NO: 2563 - DNA, 33 bp, homo sapien
cattgaattaaggccgmctctcatgatctcatt

SEQ ID NO: 2564 - DNA, 33 bp, homo sapien
ggatcttgcttagcccrtgcacacagcatcttg

SEQ ID NO: 2565 - DNA, 33 bp, homo sapien
atcttgtgatctctacyactattttggagtaaa

SEQ ID NO: 2566 - DNA, 33 bp, homo sapien
cagggagtgataccacrataaacgatattttct

SEQ ID NO: 2567 - DNA, 33 bp, homo sapien
ttggctgatggcagaawatttttttcaccttgt

SEQ ID NO: 2568 - DNA, 33 bp, homo sapien
caaggaaggtattatgmtctttacactaaagga

SEQ ID NO: 2569 - DNA, 33 bp, homo sapien
taacataagaaatgatygactagagtactgaga

SEQ ID NO: 2570 - DNA, 33 bp, homo sapien
tcacagatcaaagaacmactgaatggaatcatg

SEQ ID NO: 2571 - DNA, 33 bp, homo sapien
caatatcttctaaatamtccacccaatgcccca

SEQ ID NO: 2572 - DNA, 33 bp, homo sapien
gtttttttaaagagtartgttctcatctttccc

SEQ ID NO: 2573 - DNA, 33 bp, homo sapien
agatagagtgcacagtrtgttcaaaggccctgc

SEQ ID NO: 2574 - DNA, 33 bp, homo sapien
acttattattgtgagcrgtaggtcttgaaagtg

SEQ ID NO: 2575 - DNA, 33 bp, homo sapien
ggatggatctctgtcaytaaggaatgttttctc

SEQ ID NO: 2576 - DNA, 33 bp, homo sapien
gaggaaaagcgaggagrtaaaatgccctggttc

SEQ ID NO: 2577 - DNA, 33 bp, homo sapien
cctgactcacagatcayatatcggcagagaacg

SEQ ID NO: 2578 - DNA, 33 bp, homo sapien
tgtctctgtttttatcrggaaagaagatctttg

SEQ ID NO: 2579 - DNA, 33 bp, homo sapien
ggaggctgcctactttwgacaactacaatatcc

SEQ ID NO: 2580 - DNA, 33 bp, homo sapien
aatggaatgaattttasaaccagacatataatg

SEQ ID NO: 2581 - DNA, 33 bp, homo sapien
gtaatgaattattgagrgttgttcattggaaaa

SEQ ID NO: 2582 - DNA, 33 bp, homo sapien
tttcatgtttgcttttyatttgtcagtgaatat

SEQ ID NO: 2583 - DNA, 33 bp, homo sapien
tgcaaagcgaactcaarggaagaggcttccctg

SEQ ID NO: 2584 - DNA, 33 bp, homo sapien
acatgtgcatacatgarttttgtttatcgtctg

SEQ ID NO: 2585 - DNA, 33 bp, homo sapien
agaaaaaggagaggtgygatcatagcccagcaa

SEQ ID NO: 2586 - DNA, 33 bp, homo sapien
taaattcaaaaagaagyagtagatgattaagta

SEQ ID NO: 2587 - DNA, 33 bp, homo sapien
ttgaacaacttcctccrcagtaactgaacacat

SEQ ID NO: 2588 - DNA, 33 bp, homo sapien
agcctatagaaagtctyttatgccatggatctg

SEQ ID NO: 2589 - DNA, 33 bp, homo sapien
aataacaaatgaccggkgaccaaccaccaacag

SEQ ID NO: 2590 - DNA, 33 bp, homo sapien
gtaaggacagttctaayggcttccatttgcctt

SEQ ID NO: 2591 - DNA, 33 bp, homo sapien
gttaggatacagtatcrtggctagtgctggaca

SEQ ID NO: 2592 - DNA, 33 bp, homo sapien
tagtgttcagccaggawctaagaaagaagatta

SEQ ID NO: 2593 - DNA, 33 bp, homo sapien
taggacatcagaaaaakactagaccaggtgtca

SEQ ID NO: 2594 - DNA, 33 bp, homo sapien
ttcagctgactggtgcmtgggaaggattaaagc

SEQ ID NO: 2595 - DNA, 33 bp, homo sapien
agataacagacactaastggtacagatcagctg

SEQ ID NO: 2596 - DNA, 33 bp, homo sapien
catgctatggaacccakttttttctttaactgg

SEQ ID NO: 2597 - DNA, 33 bp, homo sapien
tcctgacaaatcatgaraatatgagattaagaa

SEQ ID NO: 2598 - DNA, 33 bp, homo sapien
ctgctgtgcttatactrtgactgaatgtagttt

SEQ ID NO: 2599 - DNA, 33 bp, homo sapien
tacttaagtgagtaaaytctatctagctcattc

SEQ ID NO: 2600 - DNA, 33 bp, homo sapien
ttggtcttcaatttccwtatgaagatgctgtac

SEQ ID NO: 2601 - DNA, 33 bp, homo sapien
cttcttgtcttagtgaygatttttcttgtgatt

SEQ ID NO: 2602 - DNA, 33 bp, homo sapien
ttttccccataagtgcratattctcctttatct

SEQ ID NO: 2603 - DNA, 33 bp, homo sapien
gatcagccagagaagtytgaggaggataaggac

SEQ ID NO: 2604 - DNA, 33 bp, homo sapien
aagtaacaggactcggyaacttcttggatgtgt

SEQ ID NO: 2605 - DNA, 33 bp, homo sapien
catgtacctgtagttcytgttacttaggaggcc

SEQ ID NO: 2606 - DNA, 33 bp, homo sapien
tacccaaatctttctgyctaacctgtattttgg

SEQ ID NO: 2607 - DNA, 33 bp, homo sapien
atgctgtaggcatgatsttgtggtctgaaccag

SEQ ID NO: 2608 - DNA, 33 bp, homo sapien
ttgacaagcagattttwaaatttatgtggaatt

SEQ ID NO: 2609 - DNA, 33 bp, homo sapien
tccccaggcctctttasttttggttatgctgtg

SEQ ID NO: 2610 - DNA, 33 bp, homo sapien
tcggcattctctctgcrgattcacctattctgg

SEQ ID NO: 2611 - DNA, 33 bp, homo sapien
aatgtttattcacaatktgagactcgctttgct

SEQ ID NO: 2612 - DNA, 33 bp, homo sapien
tctaatacctgatgacstaatctttttattgct

SEQ ID NO: 2613 - DNA, 33 bp, homo sapien
ataacaggagagggaarcaaatgaccaaatagg

SEQ ID NO: 2614 - DNA, 33 bp, homo sapien
gaaactgaggctagcamgcaaaacacctcagtc

SEQ ID NO: 2615 - DNA, 33 bp, homo sapien
gctagacaataatacgrcttgattagttcttta

SEQ ID NO: 2616 - DNA, 33 bp, homo sapien
cagagggttgtttccawgccctttagatgaaga

SEQ ID NO: 2617 - DNA, 33 bp, homo sapien
tagtaagtgacctacaytggagtcctgaatcca

SEQ ID NO: 2618 - DNA, 33 bp, homo sapien
tttagcagcattcctcrcttctactcactagat

SEQ ID NO: 2619 - DNA, 33 bp, homo sapien
aatgttttagcatataycatcaggcaaaactat

SEQ ID NO: 2620 - DNA, 33 bp, homo sapien
cagtgaaaaactcaggytaggatgagaataatg

SEQ ID NO: 2621 - DNA, 33 bp, homo sapien
ttgcctgagtaggagaytggaaggaaggagaag

SEQ ID NO: 2622 - DNA, 33 bp, homo sapien
tctttccattgagataygtattacatgttgttg

SEQ ID NO: 2623 - DNA, 33 bp, homo sapien
gtgctgttattttagcrtaagctcatttgtact

SEQ ID NO: 2624 - DNA, 33 bp, homo sapien
aagcagcttggcattgwtcaaacactttactat

SEQ ID NO: 2625 - DNA, 33 bp, homo sapien
cataatgttgcctacasaactgtatgggtcagc

SEQ ID NO: 2626 - DNA, 33 bp, homo sapien
gttcgagcagatacttmtaggaaagagactttc

SEQ ID NO: 2627 - DNA, 33 bp, homo sapien
tgtggagaaaataaaaygttagggtgaatgctg

SEQ ID NO: 2628 - DNA, 33 bp, homo sapien
tctgctttccctgattmtttacaagtttctcct

SEQ ID NO: 2629 - DNA, 33 bp, homo sapien
ctattatatgtcttaawcttttgatatgaggcc

SEQ ID NO: 2630 - DNA, 33 bp, homo sapien
ttctgtattttacacayatagcctgttacaaaa

SEQ ID NO: 2631 - DNA, 33 bp, homo sapien
atatttcacataaaagyacacgagaccattaaa

SEQ ID NO: 2632 - DNA, 33 bp, homo sapien
ttcccataaagattttsagccttctggaagtat

SEQ ID NO: 2633 - DNA, 33 bp, homo sapien
catggcttccttagcaygagagcagactcttgg

SEQ ID NO: 2634 - DNA, 33 bp, homo sapien
aagccagaggaccaggraagttgtgacttagca

SEQ ID NO: 2635 - DNA, 33 bp, homo sapien
ctaagtactattcccasgacaaaactggcacat

SEQ ID NO: 2636 - DNA, 33 bp, homo sapien
tgtaagcagccactggrcaggactaagctatcc

SEQ ID NO: 2637 - DNA, 33 bp, homo sapien
gttcttttcattcaccragccaactgtgacaaa

SEQ ID NO: 2638 - DNA, 33 bp, homo sapien
tttaaaagtctgtataygagtttaagtccactt

SEQ ID NO: 2639 - DNA, 33 bp, homo sapien
aaacattctcccaggcsattctaacgtatggtc

SEQ ID NO: 2640 - DNA, 33 bp, homo sapien
ttattcgaaatgcaatmcatttggaactggaga

SEQ ID NO: 2641 - DNA, 33 bp, homo sapien
aaatatctatggcaaastttttctgctttaaga

SEQ ID NO: 2642 - DNA, 33 bp, homo sapien
agatcagtctctggaaygtgggatctaattcca

SEQ ID NO: 2643 - DNA, 33 bp, homo sapien
gctacatagtgaggaayggtagttgattaaatg

SEQ ID NO: 2644 - DNA, 33 bp, homo sapien
tgatggctacaaggaamgaagagctatcctaga

SEQ ID NO: 2645 - DNA, 33 bp, homo sapien
ttcacaagtgaagttgstgtcaggtaacttgcc

SEQ ID NO: 2646 - DNA, 33 bp, homo sapien
cagtattcttagtgtcytcatctttgagtctgc

SEQ ID NO: 2647 - DNA, 33 bp, homo sapien
ggccttttgccaggaaytgaatgcccataggga

SEQ ID NO: 2648 - DNA, 33 bp, homo sapien
aaagcatggcaagccartcttacacaaatgctg

SEQ ID NO: 2649 - DNA, 33 bp, homo sapien
acaaatgactaaaacamttgcatttaaatgact

SEQ ID NO: 2650 - DNA, 33 bp, homo sapien
tcttaatgccttttgaktaaacaaaattatggt

SEQ ID NO: 2651 - DNA, 33 bp, homo sapien
gctaattagatcaggamcctaatctaaccttgc

SEQ ID NO: 2652 - DNA, 33 bp, homo sapien
tatggacctgtgactayagaacatttttcgtga

SEQ ID NO: 2653 - DNA, 33 bp, homo sapien
actatatgaatgtaagytggatgtactatttta

SEQ ID NO: 2654 - DNA, 33 bp, homo sapien
aaactggattaatcccwtgtgtttgagctctga

SEQ ID NO: 2655 - DNA, 33 bp, homo sapien
ggtcttaaacaataagmctttacttagtgcatg

SEQ ID NO: 2656 - DNA, 33 bp, homo sapien
gatgtgtttatactatyaccatcatcagtatca

SEQ ID NO: 2657 - DNA, 33 bp, homo sapien
aaacttctagtagcaawaacagcagcagctata

SEQ ID NO: 2658 - DNA, 33 bp, homo sapien
tcttaaataagatttgraagtccagattactct

SEQ ID NO: 2659 - DNA, 33 bp, homo sapien
gacctctcttccctcgsaatggtgtctttactt

SEQ ID NO: 2660 - DNA, 33 bp, homo sapien
catgctcaaggacagcraaaatgagggataaga

SEQ ID NO: 2661 - DNA, 33 bp, homo sapien
ttaggccagacacttayattttacactgtgaac

SEQ ID NO: 2662 - DNA, 33 bp, homo sapien
cactagacctagagagyacctggctataggaat

SEQ ID NO: 2663 - DNA, 33 bp, homo sapien
aatctaatgattcagcrtagttcactacttgcc

SEQ ID NO: 2664 - DNA, 33 bp, homo sapien
tttgcattccgtttacmaagggaaagaaggatt

SEQ ID NO: 2665 - DNA, 33 bp, homo sapien
taaacatacaaaattasaaatagcaattcacat

SEQ ID NO: 2666 - DNA, 33 bp, homo sapien
agccccaaatcaatttkcttctctgtgtaatca

SEQ ID NO: 2667 - DNA, 33 bp, homo sapien
ttcacgtaacgtctttygatgccacattgtcct

SEQ ID NO: 2668 - DNA, 33 bp, homo sapien
agaaagtagactgagcrtgtggaaataaggagc

SEQ ID NO: 2669 - DNA, 33 bp, homo sapien
aatcctgactgcaaacmtactaatggagagtac

SEQ ID NO: 2670 - DNA, 33 bp, homo sapien
tgtgtgagagctgcttsagaactgtgtgtcatg

SEQ ID NO: 2671 - DNA, 33 bp, homo sapien
cagacagccaggaactrctaaaaagacatggga

SEQ ID NO: 2672 - DNA, 33 bp, homo sapien
tttatcaaatatgattrgaaaacaatgcattat

SEQ ID NO: 2673 - DNA, 33 bp, homo sapien
atctatctcggctgagrtaaaacaaggccaatc

SEQ ID NO: 2674 - DNA, 33 bp, homo sapien
aaccaaggtaaggcccraagtattgattgtcag

SEQ ID NO: 2675 - DNA, 33 bp, homo sapien
cccctatgggcacccamaccaagcagtttaaga

SEQ ID NO: 2676 - DNA, 33 bp, homo sapien
caataggcttattcagyggcagcccaggtgggg

SEQ ID NO: 2677 - DNA, 33 bp, homo sapien
caataagcaattgattygaaaacctgtgtaatc

SEQ ID NO: 2678 - DNA, 33 bp, homo sapien
gaagtcaagctgtgcaragtcaattcaactttg

SEQ ID NO: 2679 - DNA, 33 bp, homo sapien
ggaacattatgcatgtkttacaaagaatgagcc

SEQ ID NO: 2680 - DNA, 33 bp, homo sapien
ctggcttcagaaaggayccaatgtctctttcag

SEQ ID NO: 2681 - DNA, 33 bp, homo sapien
atggaaggctactggartaatatttttgggcag

SEQ ID NO: 2682 - DNA, 33 bp, homo sapien
gacaatacgtgcacaaygggacatagaccctca

SEQ ID NO: 2683 - DNA, 33 bp, homo sapien
tcaaaataaccacaaasagaagtcccagaaatt

SEQ ID NO: 2684 - DNA, 33 bp, homo sapien
gcactgattgcatgagsagatccacgtcccata

SEQ ID NO: 2685 - DNA, 33 bp, homo sapien
aaacatgaacaggataytatgaaaaaagaacaa

SEQ ID NO: 2686 - DNA, 33 bp, homo sapien
gaataaaataattgttstcatagagttcctaat

SEQ ID NO: 2687 - DNA, 33 bp, homo sapien
tttaaatacgtatgaaygatacagtttactttt

SEQ ID NO: 2688 - DNA, 33 bp, homo sapien
attctttttcttagctrctaaaatctgtttctc

SEQ ID NO: 2689 - DNA, 33 bp, homo sapien
catcagcatctaggatragacgaaaacgaaggg

SEQ ID NO: 2690 - DNA, 33 bp, homo sapien
tggtggtgtgaacagtmtgaataaaaggagatg

SEQ ID NO: 2691 - DNA, 33 bp, homo sapien
gcaatgaagggatgaargaatgaatgagtttat

SEQ ID NO: 2692 - DNA, 33 bp, homo sapien
tttgtgaaccaggccasgtcttaaaaatgagat

SEQ ID NO: 2693 - DNA, 33 bp, homo sapien
catttccttaaggtccsatcatcttttaatccc

SEQ ID NO: 2694 - DNA, 33 bp, homo sapien
gtgaactataggtgtgytagaatgtactcattt

SEQ ID NO: 2695 - DNA, 33 bp, homo sapien
tctttgtgtcaggaaargcctatttattctgac

SEQ ID NO: 2696 - DNA, 33 bp, homo sapien
caagatcctcaacagtycttatccaaacttgcc

SEQ ID NO: 2697 - DNA, 33 bp, homo sapien
ctttattaaagaaccaygcagaagtgctcagga

SEQ ID NO: 2698 - DNA, 33 bp, homo sapien
tttctgacaatgaacakggtaagtataataatc

SEQ ID NO: 2699 - DNA, 33 bp, homo sapien
acatgaataagtaagcycttgttaacatgtgtg

SEQ ID NO: 2700 - DNA, 33 bp, homo sapien
tatgaaacattttcagyaagttcattagttggg

SEQ ID NO: 2701 - DNA, 33 bp, homo sapien
gtacctaaaattctaarggactaacttttctta

SEQ ID NO: 2702 - DNA, 33 bp, homo sapien
agaacacgtgagaaacytaggccattatacagg

SEQ ID NO: 2703 - DNA, 33 bp, homo sapien
tcacttaaagctcaagsgctcttcaatcagctt

SEQ ID NO: 2704 - DNA, 33 bp, homo sapien
ataaaagttctgattayattgtagagttttatt

SEQ ID NO: 2705 - DNA, 33 bp, homo sapien
ctgatgagactagaatsaattaactccagtgcc

SEQ ID NO: 2706 - DNA, 33 bp, homo sapien
caatcaatgtcagttasgacttatggataaaca

SEQ ID NO: 2707 - DNA, 33 bp, homo sapien
atttcaaactctgagcwctaaaatatactctga

SEQ ID NO: 2708 - DNA, 33 bp, homo sapien
tctctaaagactgagcrtagggttcccagttcc

SEQ ID NO: 2709 - DNA, 33 bp, homo sapien
ctgacatttaagctaaytttgtcatgggatgtc

SEQ ID NO: 2710 - DNA, 33 bp, homo sapien
cccagaggtatgcaggyttcaggcacagtttga

SEQ ID NO: 2711 - DNA, 33 bp, homo sapien
tcacaatgaatacgacrgcgacaacttacgctg

SEQ ID NO: 2712 - DNA, 33 bp, homo sapien
aaaagattacatttccrtacaagaagtccagat

SEQ ID NO: 2713 - DNA, 33 bp, homo sapien
gaccacagccatcctcrgtagactttaaacaac

SEQ ID NO: 2714 - DNA, 33 bp, homo sapien
aagacttaaaatcaacrgatagaaattgtcctg

SEQ ID NO: 2715 - DNA, 33 bp, homo sapien
ctcttgctgtttgggtkgttcaaccaaggtcaa

SEQ ID NO: 2716 - DNA, 33 bp, homo sapien
tccaataagactctctytacgtaattttaggct

SEQ ID NO: 2717 - DNA, 33 bp, homo sapien
actacattttttataarggccttgagcatccat

SEQ ID NO: 2718 - DNA, 33 bp, homo sapien
atggtctaatgaattcyctttcttcttgtttgt

SEQ ID NO: 2719 - DNA, 33 bp, homo sapien
ctcatgatgttcccagstcatttggcttctgga

SEQ ID NO: 2720 - DNA, 33 bp, homo sapien
tgctacttacagcaagygacaagtcaaagaagt

SEQ ID NO: 2721 - DNA, 33 bp, homo sapien
gaaggcgagcaaacgcyagcaaggtggaaatat

SEQ ID NO: 2722 - DNA, 33 bp, homo sapien
atacctgacaaaattgygtgatatgacaaaatg

SEQ ID NO: 2723 - DNA, 33 bp, homo sapien
catttgtctcttgcacycagttcacacagactt

SEQ ID NO: 2724 - DNA, 33 bp, homo sapien
gcacatcaagtagcctrtttcctctaaataaca

SEQ ID NO: 2725 - DNA, 33 bp, homo sapien
tctttctttcttgcatytgagctttaacgttga

SEQ ID NO: 2726 - DNA, 33 bp, homo sapien
aggataatgctagaggmtccagctgggccacag

SEQ ID NO: 2727 - DNA, 33 bp, homo sapien
agtagagagagaactcyagcaaggtggattggt

SEQ ID NO: 2728 - DNA, 33 bp, homo sapien
gtagaatgacaatcacygtggtgggtttggagg

SEQ ID NO: 2729 - DNA, 33 bp, homo sapien
attgaggttatggcttyccttacataagaaaaa

SEQ ID NO: 2730 - DNA, 33 bp, homo sapien
atttgagaagagacgcrttggtaattgtgtaca

SEQ ID NO: 2731 - DNA, 33 bp, homo sapien
atgagaaagatttgaastacatataattccata

SEQ ID NO: 2732 - DNA, 33 bp, homo sapien
tgtttttgtctttatcktttgttagagttatag

SEQ ID NO: 2733 - DNA, 33 bp, homo sapien
ttcatgtctgctaatayattcttcagcccaaag

SEQ ID NO: 2734 - DNA, 33 bp, homo sapien
tgagtatattatctcamatggcacaagggactt

SEQ ID NO: 2735 - DNA, 33 bp, homo sapien
ttaattgtctccctcaragcaaggccattaagc

SEQ ID NO: 2736 - DNA, 33 bp, homo sapien
gacagactcttggattyaggcttaggacaagca

SEQ ID NO: 2737 - DNA, 33 bp, homo sapien
aagataatgggtaaggmtgagaaagctgtaaaa

SEQ ID NO: 2738 - DNA, 33 bp, homo sapien
aagcgtgatcaaacatmaaatgcactataaatc

SEQ ID NO: 2739 - DNA, 33 bp, homo sapien
atgaccaggaagtgccrccaaacctctgataca

SEQ ID NO: 2740 - DNA, 33 bp, homo sapien
tcacattctaaacatcrtaaggaaattaaatat

SEQ ID NO: 2741 - DNA, 33 bp, homo sapien
ggccaaggaacctctgygaatgaagcacttccc

SEQ ID NO: 2742 - DNA, 33 bp, homo sapien
ctggccatttatgttcygacccaaaggacaaat

SEQ ID NO: 2743 - DNA, 33 bp, homo sapien
gtggtttgagtactacytcagccacagtacaat

SEQ ID NO: 2744 - DNA, 33 bp, homo sapien
tatgtcctgccttattkgagattctagatcatt

SEQ ID NO: 2745 - DNA, 33 bp, homo sapien
gtatattcctatccttytgtggacagtgaaacc

SEQ ID NO: 2746 - DNA, 33 bp, homo sapien
ggggcaagtcaatgacyatgagagaatgccagc

SEQ ID NO: 2747 - DNA, 33 bp, homo sapien
ttgctttgcaacatcaygacaaacactacagct

SEQ ID NO: 2748 - DNA, 33 bp, homo sapien
ttatgtctccctaggawgtgtaaaagccagttg

SEQ ID NO: 2749 - DNA, 33 bp, homo sapien
ctgcgcccataggagcygggaccatttctggct

SEQ ID NO: 2750 - DNA, 33 bp, homo sapien
tgacaattacaggcttrtttttagagacaggtg

SEQ ID NO: 2751 - DNA, 33 bp, homo sapien
tcctctcctggctcctkgtcattacgggaaatc

SEQ ID NO: 2752 - DNA, 33 bp, homo sapien
aataattaagaaacagsagtatcatgaaaacaa

SEQ ID NO: 2753 - DNA, 33 bp, homo sapien
tgctacacagccattaracatgaacctgggtct

SEQ ID NO: 2754 - DNA, 33 bp, homo sapien
aaaatttcttacgtagrgattagtgctgattat

SEQ ID NO: 2755 - DNA, 33 bp, homo sapien
agatcctgcacagataygaaggcttactatttt

SEQ ID NO: 2756 - DNA, 33 bp, homo sapien
ttgggctcattgctcarcttctctgtgcctcaa

SEQ ID NO: 2757 - DNA, 33 bp, homo sapien
aaaccattgcaaaggargatccacatctatatg

SEQ ID NO: 2758 - DNA, 33 bp, homo sapien
tgtgctttctgggtgcwttacacttctacaaag

SEQ ID NO: 2759 - DNA, 33 bp, homo sapien
aggatgatttattaagwtgtaaggattcaggag

SEQ ID NO: 2760 - DNA, 33 bp, homo sapien
tggctgcaacagagacsgtgtggcctgccaaaa

SEQ ID NO: 2761 - DNA, 33 bp, homo sapien
tttgcaaggcatacagrcagctgaagaacactg

SEQ ID NO: 2762 - DNA, 33 bp, homo sapien
tctgataatgttcagayatccagttatagagct

SEQ ID NO: 2763 - DNA, 33 bp, homo sapien
taaaattctaatagtgraaatatgacttgatgt

SEQ ID NO: 2764 - DNA, 33 bp, homo sapien
agtcatcataaggaagmaagtttggtttggtga

SEQ ID NO: 2765 - DNA, 33 bp, homo sapien
aactacgaaatccaaaygcagggagagtggcgc

SEQ ID NO: 2766 - DNA, 33 bp, homo sapien
cttccaaagatgaaaasagaattcctagtactc

SEQ ID NO: 2767 - DNA, 33 bp, homo sapien
ttacttctgtcttcttraaaaatccagcattgc

SEQ ID NO: 2768 - DNA, 33 bp, homo sapien
atgggtcaatatgatcsctgtaaagcatagact

SEQ ID NO: 2769 - DNA, 33 bp, homo sapien
aaaattaaaatgtgtcrtagagctgaatgcagt

SEQ ID NO: 2770 - DNA, 33 bp, homo sapien
atgtagaaagatgaagrttcaggcattacctgc

SEQ ID NO: 2771 - DNA, 33 bp, homo sapien
ttttgcaaagtacccarttcactacccatcttc

SEQ ID NO: 2772 - DNA, 33 bp, homo sapien
ataggcttacgtttatycaaaagcatctcacct

SEQ ID NO: 2773 - DNA, 33 bp, homo sapien
ggaagtgacagaagggwtgtatatgtaatttta

SEQ ID NO: 2774 - DNA, 33 bp, homo sapien
cattccaggaagcagaytgtggacttagttgtc

SEQ ID NO: 2775 - DNA, 33 bp, homo sapien
attcaaggataaaagaygcatttgtgataatta

SEQ ID NO: 2776 - DNA, 33 bp, homo sapien
taaattctagtcagacygattatctgctctcga

SEQ ID NO: 2777 - DNA, 33 bp, homo sapien
gctctgcaaggaatttkcccaacaaaggcactt

SEQ ID NO: 2778 - DNA, 33 bp, homo sapien
tgctgagaagatgaatrtatacaaatctatgaa

SEQ ID NO: 2779 - DNA, 33 bp, homo sapien
actgatcaaatatctcyggcatttcaaaggcat

SEQ ID NO: 2780 - DNA, 33 bp, homo sapien
ctgtgagttagaagaamctttatcacagtttta

SEQ ID NO: 2781 - DNA, 33 bp, homo sapien
gttgaaagagccagctycacaaccagacacacc

SEQ ID NO: 2782 - DNA, 33 bp, homo sapien
gctgctttccctgcacratccaggtccttggtt

SEQ ID NO: 2783 - DNA, 33 bp, homo sapien
ggccaaaatattaccartgctactgataaagct

SEQ ID NO: 2784 - DNA, 33 bp, homo sapien
gtaatttgctaggtcaycattgagtaggaatgt

SEQ ID NO: 2785 - DNA, 33 bp, homo sapien
aaaaccattgcaaataycaacaccagcgatggc

SEQ ID NO: 2786 - DNA, 33 bp, homo sapien
ttctgttctcatttgcyttacgggtgtctgagg

SEQ ID NO: 2787 - DNA, 33 bp, homo sapien
ggtatctggtctagcamaaaatcggatatgtgg

SEQ ID NO: 2788 - DNA, 33 bp, homo sapien
ggtaaatatgattgtcrcctcctgaattaaagg

SEQ ID NO: 2789 - DNA, 33 bp, homo sapien
ccctgtaaggttgcaayagaagattgaaaaagc

SEQ ID NO: 2790 - DNA, 33 bp, homo sapien
gcccattcatggtgtcrtatagaaggggcaaaa

SEQ ID NO: 2791 - DNA, 33 bp, homo sapien
aaatggggttcgctgarttattcttgtttgtca

SEQ ID NO: 2792 - DNA, 33 bp, homo sapien
aagatttcagaatgggycaagcttaggtaacta

SEQ ID NO: 2793 - DNA, 33 bp, homo sapien
agtttatttcaagtatragagagatgtatatag

SEQ ID NO: 2794 - DNA, 33 bp, homo sapien
tccccaaatatcagtgkcttcatataccaaagt

SEQ ID NO: 2795 - DNA, 33 bp, homo sapien
agtgaaggtatgtattrtaagacctacagttgc

SEQ ID NO: 2796 - DNA, 33 bp, homo sapien
gctggtagtttaacatkcacgtattttgctgca

SEQ ID NO: 2797 - DNA, 33 bp, homo sapien
ataaatttgttcagtcktctaataattttattc

SEQ ID NO: 2798 - DNA, 33 bp, homo sapien
actttcatcctttcacmttttgacacacaaaaa

SEQ ID NO: 2799 - DNA, 33 bp, homo sapien
tttcccaagttcatagktagtaacaaagaatga

SEQ ID NO: 2800 - DNA, 33 bp, homo sapien
aggcatcccaaatatcktctagtgtaggttttg

SEQ ID NO: 2801 - DNA, 33 bp, homo sapien
aaaatggggacatgcgkaacactgaaaacattt

SEQ ID NO: 2802 - DNA, 33 bp, homo sapien
ctaggagactaagtggwtagaaaagacatgcat

SEQ ID NO: 2803 - DNA, 33 bp, homo sapien
ggtaatggatatgatgkttatcttgattttggt

SEQ ID NO: 2804 - DNA, 33 bp, homo sapien
gtgtggtacatttgttrcaagtaatgggctagt

SEQ ID NO: 2805 - DNA, 33 bp, homo sapien
agcctggaagtacagayctaccaagtgcttaag

SEQ ID NO: 2806 - DNA, 33 bp, homo sapien
aggacctgggctctctwttctcctttgcttttc

SEQ ID NO: 2807 - DNA, 33 bp, homo sapien
ggaagaaagcatcatartaatgtgggtgatgag

SEQ ID NO: 2808 - DNA, 33 bp, homo sapien
tttagtttcttaaaatytcattgaatcttacag

SEQ ID NO: 2809 - DNA, 33 bp, homo sapien
ttaccctgaattgaccrtcacataatgtataca

SEQ ID NO: 2810 - DNA, 33 bp, homo sapien
cctccatttctctctgrtgtcaaagatttttac

SEQ ID NO: 2811 - DNA, 33 bp, homo sapien
tccgcctccgacctgtrgctggcctgctttcct

SEQ ID NO: 2812 - DNA, 33 bp, homo sapien
tgcgaagcatttttgcmgtttatcaatcgtctc

SEQ ID NO: 2813 - DNA, 33 bp, homo sapien
aatagactcaatgaagrttcagagggctgccac

SEQ ID NO: 2814 - DNA, 33 bp, homo sapien
ccctggggattgaatgkgccatactagctgagt

SEQ ID NO: 2815 - DNA, 33 bp, homo sapien
gtttctggccaactcawcgatacaaaaacattc

SEQ ID NO: 2816 - DNA, 33 bp, homo sapien
tttggatcgggcagccrttgtgcacttggatat

SEQ ID NO: 2817 - DNA, 33 bp, homo sapien
atagtagcaaggactcyataggaattatgtatg

SEQ ID NO: 2818 - DNA, 33 bp, homo sapien
aggtcactgtgctaagyagtgaagtcctcatgg

SEQ ID NO: 2819 - DNA, 33 bp, homo sapien
ccatttgcctacttgayccacattttcatgcct

SEQ ID NO: 2820 - DNA, 33 bp, homo sapien
agagagtaaacaacccrttcaagacaatcaact

SEQ ID NO: 2821 - DNA, 33 bp, homo sapien
atgggcaaaggcgtaargaggtgagaaagtgag

SEQ ID NO: 2822 - DNA, 33 bp, homo sapien
aaccagatcagcaaagygctgtaactatggcct

SEQ ID NO: 2823 - DNA, 33 bp, homo sapien
tatttaacctatcaaaraattgtgtcttacagt

SEQ ID NO: 2824 - DNA, 33 bp, homo sapien
ctcaattagtatcatcygaatgtcccaggtgaa

SEQ ID NO: 2825 - DNA, 33 bp, homo sapien
agtgaattgtaagtacragtgtcagccatcctg

SEQ ID NO: 2826 - DNA, 33 bp, homo sapien
cagattctggatacttkcagccagctctaaagc

SEQ ID NO: 2827 - DNA, 33 bp, homo sapien
agggtgatgacataatrtatcactcataacagg

SEQ ID NO: 2828 - DNA, 33 bp, homo sapien
aacaactatgaacgatrttgaggtgactgataa

SEQ ID NO: 2829 - DNA, 33 bp, homo sapien
gaactacatcgagtgargtcagtgttgaaaacg

SEQ ID NO: 2830 - DNA, 33 bp, homo sapien
attaatctgatatttcrgttgcaggctattagt

SEQ ID NO: 2831 - DNA, 33 bp, homo sapien
ctaaagctctagtaatyaagacagtgtgcataa

SEQ ID NO: 2832 - DNA, 33 bp, homo sapien
gccagtgagatgctatygatgttgctagttgct

SEQ ID NO: 2833 - DNA, 33 bp, homo sapien
ggttttatgaggggctyttccaccttcgcttcc

SEQ ID NO: 2834 - DNA, 33 bp, homo sapien
gcctccatgtctgagaytcagaacctcaacagt

SEQ ID NO: 2835 - DNA, 33 bp, homo sapien
ctccctcctccacactmatttctctaagtcttc

SEQ ID NO: 2836 - DNA, 33 bp, homo sapien
gaaattagaagtttacwtttcatattggaccag

SEQ ID NO: 2837 - DNA, 33 bp, homo sapien
ttgacataaaatggaayattacataccctcaac

SEQ ID NO: 2838 - DNA, 33 bp, homo sapien
attagtattttccaaayttattgtactaccagt

SEQ ID NO: 2839 - DNA, 33 bp, homo sapien
tctcaattacagccgtktaagacattttcttcc

SEQ ID NO: 2840 - DNA, 33 bp, homo sapien
acccagagtacttgacrgtgtcctcaataaaat

SEQ ID NO: 2841 - DNA, 33 bp, homo sapien
aatgtccaagcgacatyaggtgttttagtacag

SEQ ID NO: 2842 - DNA, 33 bp, homo sapien
atctaaagggagagatrggcttcaatgcaacaa

SEQ ID NO: 2843 - DNA, 33 bp, homo sapien
ctctgctgagctctttrtttctatacacttatt

SEQ ID NO: 2844 - DNA, 33 bp, homo sapien
ctcagcatgaagcagcyggaaagatctatgccc

SEQ ID NO: 2845 - DNA, 33 bp, homo sapien
tggaagtccgtacttgscattttctcttaagtt

SEQ ID NO: 2846 - DNA, 33 bp, homo sapien
ttggctagcttcatggyatctggatgcatgcat

SEQ ID NO: 2847 - DNA, 33 bp, homo sapien
aactccaagcaagtaamttattctttctgtgcc

SEQ ID NO: 2848 - DNA, 33 bp, homo sapien
gctcaaaaatgctgatratcatgcaaggcttca

SEQ ID NO: 2849 - DNA, 33 bp, homo sapien
ctcatggttagtatggrttggtgtatttctagt

SEQ ID NO: 2850 - DNA, 33 bp, homo sapien
agacatcttgtggagaycattttaaccattgat

SEQ ID NO: 2851 - DNA, 33 bp, homo sapien
aaaatagagataagacwgaggaaatataagaat

SEQ ID NO: 2852 - DNA, 33 bp, homo sapien
ttctctcctcttattaygtgaattgtctaggtt

SEQ ID NO: 2853 - DNA, 33 bp, homo sapien
atgagaaatagcttcartacagtccagagggac

SEQ ID NO: 2854 - DNA, 33 bp, homo sapien
acatatctccaatgttyagcagcttgcatcccc

SEQ ID NO: 2855 - DNA, 33 bp, homo sapien
ctaatttatcgttttcrgaacatctctgtctac

SEQ ID NO: 2856 - DNA, 33 bp, homo sapien
ttatcattgcctggccwtgtatcttttgggtct

SEQ ID NO: 2857 - DNA, 33 bp, homo sapien
tttttcacaagtttccmagtggtgctgatactt

SEQ ID NO: 2858 - DNA, 33 bp, homo sapien
tgttattatgatccatstttatgaataagaaaa

SEQ ID NO: 2859 - DNA, 33 bp, homo sapien
attaaagggtaagatckgaaaccaactcaagtt

SEQ ID NO: 2860 - DNA, 33 bp, homo sapien
gagagcagaatacagaytaaaatccttataata

SEQ ID NO: 2861 - DNA, 33 bp, homo sapien
ggttatgttttctttgmccttacttacagcagt

SEQ ID NO: 2862 - DNA, 33 bp, homo sapien
aaaacaatatgaaatgstctttcagaggcacgg

SEQ ID NO: 2863 - DNA, 33 bp, homo sapien
agcccagagacaaaacracagctggaaagctca

SEQ ID NO: 2864 - DNA, 33 bp, homo sapien
taaggtcagcaccatcygtgatgccatgtagat

SEQ ID NO: 2865 - DNA, 33 bp, homo sapien
gagaaaggttgggcacrtggcatcagcataaat

SEQ ID NO: 2866 - DNA, 33 bp, homo sapien
ttccttttctgaatttwtagtaacgactcaaca

SEQ ID NO: 2867 - DNA, 33 bp, homo sapien
tttaacaatatttaagygtacaattcagcagca

SEQ ID NO: 2868 - DNA, 33 bp, homo sapien
tggcaggaagctggacwggagcgaagagtctcc

SEQ ID NO: 2869 - DNA, 33 bp, homo sapien
gttaccttgcaaattasaaaactcttggcacaa

SEQ ID NO: 2870 - DNA, 33 bp, homo sapien
tgtaggatggccaaackcagcagacaggagcca

SEQ ID NO: 2871 - DNA, 33 bp, homo sapien
atctattacctgtaacyggtccttgtctcctct

SEQ ID NO: 2872 - DNA, 33 bp, homo sapien
aaagttcctctctgacrttcaaccacatgctct

SEQ ID NO: 2873 - DNA, 33 bp, homo sapien
tatcaaaaaatgagttraaccaatcaatgcaca

SEQ ID NO: 2874 - DNA, 33 bp, homo sapien
atatattttaccatgcygtttattcatccattc

SEQ ID NO: 2875 - DNA, 33 bp, homo sapien
ttacattttcaaaaaayggtcagctgatcgaat

SEQ ID NO: 2876 - DNA, 33 bp, homo sapien
aagcaaatttgaagagytaggcaaattatttca

SEQ ID NO: 2877 - DNA, 33 bp, homo sapien
atggtgtgctctactcscaggagtccttactgg

SEQ ID NO: 2878 - DNA, 33 bp, homo sapien
ggtgctactctgcaccrtggtatatttacttag

SEQ ID NO: 2879 - DNA, 33 bp, homo sapien
aaattccctaatgcacscatgcttctaaaggac

SEQ ID NO: 2880 - DNA, 33 bp, homo sapien
tgacgggagtgaacaartaagagaagcaggatt

SEQ ID NO: 2881 - DNA, 33 bp, homo sapien
tttgtgaccatcatacygtggtttgacttgttg

SEQ ID NO: 2882 - DNA, 33 bp, homo sapien
gatcccatatccagcgscattcccacaggcttc

SEQ ID NO: 2883 - DNA, 33 bp, homo sapien
ctctaaaatgcaaataycccaaagcacatgact

SEQ ID NO: 2884 - DNA, 33 bp, homo sapien
gaatgaatgattccggraagttaacttgtattc

SEQ ID NO: 2885 - DNA, 33 bp, homo sapien
ttacgatatttggaaarccataaagggctaaac

SEQ ID NO: 2886 - DNA, 33 bp, homo sapien
gggagttccagaagaarttacttgaaagttagc

SEQ ID NO: 2887 - DNA, 33 bp, homo sapien
gcaagcaccacatgagstctggcggaatacgta

SEQ ID NO: 2888 - DNA, 33 bp, homo sapien
tgcaataagaacctcaraaatatatctgtgctg

SEQ ID NO: 2889 - DNA, 33 bp, homo sapien
catctgtgcaaggatcktctttatttactttaa

SEQ ID NO: 2890 - DNA, 33 bp, homo sapien
cagggctaattgctatrtatggttatgtaggtt

SEQ ID NO: 2891 - DNA, 33 bp, homo sapien
catcatgccaagtggartaagccagacacaaaa

SEQ ID NO: 2892 - DNA, 33 bp, homo sapien
ggtacaaaatgcctagsaaaatgtacgtacata

SEQ ID NO: 2893 - DNA, 33 bp, homo sapien
aacattcacgtctgtgytcctggttaggtctcc

SEQ ID NO: 2894 - DNA, 33 bp, homo sapien
gacttaatctgaatgasagttgccctaaaaagc

SEQ ID NO: 2895 - DNA, 33 bp, homo sapien
ggcatctcactgaagargatttgtttatgctcc

SEQ ID NO: 2896 - DNA, 33 bp, homo sapien
ctaaacttttacaatgrtggcagaattggtcat

SEQ ID NO: 2897 - DNA, 33 bp, homo sapien
ctgggccgccctgaaaygaatcagaggaaaaag

SEQ ID NO: 2898 - DNA, 33 bp, homo sapien
agaggagttgaaaaacmcattaagagctccctt

SEQ ID NO: 2899 - DNA, 33 bp, homo sapien
ggcctcagttttatggytgcagtatttaaacag

SEQ ID NO: 2900 - DNA, 33 bp, homo sapien
gagaattctactctatygactatattgacaatt

SEQ ID NO: 2901 - DNA, 33 bp, homo sapien
cctctctgccttttctwgtctaaagacaggccc

SEQ ID NO: 2902 - DNA, 33 bp, homo sapien
tgagagggcttacctgsttaggcacctgcgcac

SEQ ID NO: 2903 - DNA, 33 bp, homo sapien
ctgctaatcatcaattraatgaatcgctaattc

SEQ ID NO: 2904 - DNA, 33 bp, homo sapien
atggaagggaatggagrtccaggtttctgagaa

SEQ ID NO: 2905 - DNA, 33 bp, homo sapien
tcaatttgtggtaacarcaatagagaccttaac

SEQ ID NO: 2906 - DNA, 33 bp, homo sapien
cctgagttttcacagcyttagaaatgagatgtt

SEQ ID NO: 2907 - DNA, 33 bp, homo sapien
tttttgcttctccctgmaaaaaagcaagagcag

SEQ ID NO: 2908 - DNA, 33 bp, homo sapien
acaagactccaagcctractctctgctttagcc

SEQ ID NO: 2909 - DNA, 33 bp, homo sapien
tttacagacctagtccygattcttgcttctact

SEQ ID NO: 2910 - DNA, 33 bp, homo sapien
atcgtctgcaatttgaytgtaagctctttcaaa

SEQ ID NO: 2911 - DNA, 33 bp, homo sapien
gacagttctaggcagastcagaactacttttta

SEQ ID NO: 2912 - DNA, 33 bp, homo sapien
tctactcatcaaaattyctgccttacactaaca

SEQ ID NO: 2913 - DNA, 33 bp, homo sapien
tgctttactctaatacrtagctgtaacacaaat

SEQ ID NO: 2914 - DNA, 33 bp, homo sapien
taaaactttatggctartcatttgtctccagct

SEQ ID NO: 2915 - DNA, 33 bp, homo sapien
ttcatccaaaataaaayctttgtggtctaattc

SEQ ID NO: 2916 - DNA, 33 bp, homo sapien
cccgtaagatttagttmtaatgaaaggaagttc

SEQ ID NO: 2917 - DNA, 33 bp, homo sapien
cccaaaagcctgcttgrtactctaccccactgt

SEQ ID NO: 2918 - DNA, 33 bp, homo sapien
ggaagactcaaagttcyggtggctctggtgtgc

SEQ ID NO: 2919 - DNA, 33 bp, homo sapien
cagcccaaaccgtcacwgttaaccattacgcaa

SEQ ID NO: 2920 - DNA, 33 bp, homo sapien
tattgaatatttacatrttagtgctcttctgag

SEQ ID NO: 2921 - DNA, 33 bp, homo sapien
atggaatgactgagaamtaattgatacattaaa

SEQ ID NO: 2922 - DNA, 33 bp, homo sapien
ttacccaaaccctaccrtggtcatctctactcc

SEQ ID NO: 2923 - DNA, 33 bp, homo sapien
cactcttggggtatcartgagagaagaggctgg

SEQ ID NO: 2924 - DNA, 33 bp, homo sapien
aataaagtctacaggcstttaagcctctggttc

SEQ ID NO: 2925 - DNA, 33 bp, homo sapien
tttgctaaaagctctgktctcaaagccccaaat

SEQ ID NO: 2926 - DNA, 33 bp, homo sapien
agcagttttattttgaygaatctccaaaggtga

SEQ ID NO: 2927 - DNA, 33 bp, homo sapien
cactctcatctttgctytaggcactgttcagtg

SEQ ID NO: 2928 - DNA, 33 bp, homo sapien
agctccttttgcagcaragcctttcccaccatt

SEQ ID NO: 2929 - DNA, 33 bp, homo sapien
tttagagaggaaaatasgtttggagagtggtaa

SEQ ID NO: 2930 - DNA, 33 bp, homo sapien
cgatgagcgaggctccrtgcagacaggtgacat

SEQ ID NO: 2931 - DNA, 33 bp, homo sapien
cccactctctggtggcrtaaaacagaaagaagc

SEQ ID NO: 2932 - DNA, 33 bp, homo sapien
tagcaacagggagcaastggccttctacagagt

SEQ ID NO: 2933 - DNA, 33 bp, homo sapien
cgtgtttcagtggactrtataatgtagttgatg

SEQ ID NO: 2934 - DNA, 33 bp, homo sapien
gcctactttactctttycataatcactccattc

SEQ ID NO: 2935 - DNA, 33 bp, homo sapien
gaatgtaggcatttttrtacttttgaaaagtaa

SEQ ID NO: 2936 - DNA, 33 bp, homo sapien
gggggagtcattttagwtgtcttgcttaattag

SEQ ID NO: 2937 - DNA, 33 bp, homo sapien
ctgacccctgtttccawctttctatctccttct

SEQ ID NO: 2938 - DNA, 33 bp, homo sapien
acgttacaatgagttcrtgcatcaactatagtg

SEQ ID NO: 2939 - DNA, 33 bp, homo sapien
gggagaggggaatgccrtaaacagaagtatttt

SEQ ID NO: 2940 - DNA, 33 bp, homo sapien
attttgccattgcatartaaggggtatcagatt

SEQ ID NO: 2941 - DNA, 33 bp, homo sapien
aacgctaagtcagaccraggctggcccatggga

SEQ ID NO: 2942 - DNA, 33 bp, homo sapien
tcataaggaaaccaatygtgtgatttcaaggat

SEQ ID NO: 2943 - DNA, 33 bp, homo sapien
aaggttgaatccctacrtgataagaaactgcat

SEQ ID NO: 2944 - DNA, 33 bp, homo sapien
gtttctaaccacatctsctagaattgacacctg

SEQ ID NO: 2945 - DNA, 33 bp, homo sapien
cctttcacctgccttgytagctgcatttcttgg

SEQ ID NO: 2946 - DNA, 33 bp, homo sapien
atgatcactctgcaagrtattgtaggaaatatc

SEQ ID NO: 2947 - DNA, 33 bp, homo sapien
agttccatatcttattyaattcctggccattca

SEQ ID NO: 2948 - DNA, 33 bp, homo sapien
gaacaataacagcaackgcggctgctactattg

SEQ ID NO: 2949 - DNA, 33 bp, homo sapien
aaactcggattgaggtytcaatatctggggagg

SEQ ID NO: 2950 - DNA, 33 bp, homo sapien
aaatacataaaaacagrgaaacaacatgccaca

SEQ ID NO: 2951 - DNA, 33 bp, homo sapien
ctgtttctttagtacgytccctgtctcactggt

SEQ ID NO: 2952 - DNA, 33 bp, homo sapien
accagtttcttccaacmagttacttctaggcat

SEQ ID NO: 2953 - DNA, 33 bp, homo sapien
ggggtggggcaatagaytcaacctcttaatagt

SEQ ID NO: 2954 - DNA, 33 bp, homo sapien
ccagtctcatccatatyattgtcactgatacaa

SEQ ID NO: 2955 - DNA, 33 bp, homo sapien
cagatattccctttgcygatggttgggatggca

SEQ ID NO: 2956 - DNA, 33 bp, homo sapien
ttttttaatggcttggmtcttttgaatatttaa

SEQ ID NO: 2957 - DNA, 33 bp, homo sapien
atttctgatttttacaktattgcaaacctagat

SEQ ID NO: 2958 - DNA, 33 bp, homo sapien
actgagaagtgcaaggrtcaaaggctcacattg

SEQ ID NO: 2959 - DNA, 33 bp, homo sapien
atagatgggaatttttrtttgagacagatgaca

SEQ ID NO: 2960 - DNA, 33 bp, homo sapien
ggacataccatcagagraatctgccccttcctc

SEQ ID NO: 2961 - DNA, 33 bp, homo sapien
agttcaacggagtttgrgacaaaagctagactt

SEQ ID NO: 2962 - DNA, 33 bp, homo sapien
ttgaaaagagaaaagtrtgcaaaacattaaaca

SEQ ID NO: 2963 - DNA, 33 bp, homo sapien
aattcgaacttacctcwtatttgtgttaatttc

SEQ ID NO: 2964 - DNA, 33 bp, homo sapien
agaagcaaattaacatrccaacaagtcaaattc

SEQ ID NO: 2965 - DNA, 33 bp, homo sapien
gtcagagcatttgataytgagttgggtgctaac

SEQ ID NO: 2966 - DNA, 33 bp, homo sapien
cacattctgtgagtttycatttaatagttttca

SEQ ID NO: 2967 - DNA, 33 bp, homo sapien
caagctgcagttcaggyagccctgtcatttgta

SEQ ID NO: 2968 - DNA, 33 bp, homo sapien
caggagcagttcagcaycatagctaagataatg

SEQ ID NO: 2969 - DNA, 33 bp, homo sapien
ggcttctctgttcagcrtgaagtttttggaatt

SEQ ID NO: 2970 - DNA, 33 bp, homo sapien
agaatttctattcttaygtggtagaacgctttt

SEQ ID NO: 2971 - DNA, 33 bp, homo sapien
acctttttctgggagastgttccctattgagta

SEQ ID NO: 2972 - DNA, 33 bp, homo sapien
gaaaggtgattgacaartaaacttaatcatgtt

SEQ ID NO: 2973 - DNA, 33 bp, homo sapien
tgagaaacaaccagacygttagaagtgttgaag

SEQ ID NO: 2974 - DNA, 33 bp, homo sapien
tttaaaaaatgaatgasaaaataaggaatagca

SEQ ID NO: 2975 - DNA, 33 bp, homo sapien
ctttggcatatggcttycaatttgagctccctg

SEQ ID NO: 2976 - DNA, 33 bp, homo sapien
tattcaccagtaatatytaaactatgcattatt

SEQ ID NO: 2977 - DNA, 33 bp, homo sapien
ggaagcccacaggacaygtcaccttttctcatg

SEQ ID NO: 2978 - DNA, 33 bp, homo sapien
tcagtgaataagttacrtatacatggcgattaa

SEQ ID NO: 2979 - DNA, 33 bp, homo sapien
gtaacctaagagatgcyggatgttcctatcaaa

SEQ ID NO: 2980 - DNA, 33 bp, homo sapien
taccagtgtgagtttaygaggtattttatcttt

SEQ ID NO: 2981 - DNA, 33 bp, homo sapien
tacatatattttctgayttaatttttaataaca

SEQ ID NO: 2982 - DNA, 33 bp, homo sapien
aacatagagcatagctwattggcctaacagttt

SEQ ID NO: 2983 - DNA, 33 bp, homo sapien
acagaatcctttagaayatgatgaaagccatag

SEQ ID NO: 2984 - DNA, 33 bp, homo sapien
ctggctttgatgatgcyaattgctatattgggg

SEQ ID NO: 2985 - DNA, 33 bp, homo sapien
gctccagaaaagactgrtgagtactgtgattta

SEQ ID NO: 2986 - DNA, 33 bp, homo sapien
aatatccttgaaaagayggtccataacaaaaac

SEQ ID NO: 2987 - DNA, 33 bp, homo sapien
acacccttgtacctccrctataccatgcctctt

SEQ ID NO: 2988 - DNA, 33 bp, homo sapien
aatcaagtgctaattcrttataaggttattaca

SEQ ID NO: 2989 - DNA, 33 bp, homo sapien
ttttcattgtagagatmtttggttaattcctag

SEQ ID NO: 2990 - DNA, 33 bp, homo sapien
aaagtgggaatgtaacmatgttggactctttct

SEQ ID NO: 2991 - DNA, 33 bp, homo sapien
gcactgccacggtttaygttttcacaccacaat

SEQ ID NO: 2992 - DNA, 33 bp, homo sapien
gagatgaggtccataaktagatcagagttttag

SEQ ID NO: 2993 - DNA, 33 bp, homo sapien
cttccccagggtctacrcttttagaaacaaatc

SEQ ID NO: 2994 - DNA, 33 bp, homo sapien
gtcgattttagcacttytaaaatcattgttgct

SEQ ID NO: 2995 - DNA, 33 bp, homo sapien
agagtcttcaaaaggayaaaattataagcactg

SEQ ID NO: 2996 - DNA, 33 bp, homo sapien
gagaaatcttgacataytggattggaattaaga

SEQ ID NO: 2997 - DNA, 33 bp, homo sapien
tgaaagtaggcagacayattaggtggaaaatat

SEQ ID NO: 2998 - DNA, 33 bp, homo sapien
tttcagcctagggatgytcacagtaatggaaag

SEQ ID NO: 2999 - DNA, 33 bp, homo sapien
ttctagagctcgtgccrttcaacctgccaaagc

SEQ ID NO: 3000 - DNA, 33 bp, homo sapien
atgtcctttagcttcamtgtattcattactggt

SEQ ID NO: 3001 - DNA, 33 bp, homo sapien
atacatgttagtttccrttttcttctgttccac

SEQ ID NO: 3002 - DNA, 33 bp, homo sapien
aggcctactctctagcrtttataggagactggc

SEQ ID NO: 3003 - DNA, 33 bp, homo sapien
gtgaattcatccaccargtagtggcatcaatct

SEQ ID NO: 3004 - DNA, 33 bp, homo sapien
tgtatggaagaagagcrgcctacacttagtgag

SEQ ID NO: 3005 - DNA, 33 bp, homo sapien
taaatccgtcttgactsagcttcatttgtgaaa

SEQ ID NO: 3006 - DNA, 33 bp, homo sapien
tctggacactaatacayggatcttgacgaagtg

SEQ ID NO: 3007 - DNA, 33 bp, homo sapien
caaaaatagctctagcytcagtacccgccatgc

SEQ ID NO: 3008 - DNA, 33 bp, homo sapien
atagaaatcctgcgccwtttaattgagtgaata

SEQ ID NO: 3009 - DNA, 33 bp, homo sapien
agactcatcaggctggytggactctcgctgttc

SEQ ID NO: 3010 - DNA, 33 bp, homo sapien
aatctgtgtgttaggcraggcaacctcaattat

SEQ ID NO: 3011 - DNA, 33 bp, homo sapien
gcaatagaggctgatcyctgtctgtacaaaaaa

SEQ ID NO: 3012 - DNA, 33 bp, homo sapien
acatagggtcatcacayactagtcattctattt

SEQ ID NO: 3013 - DNA, 33 bp, homo sapien
ctgagctcaaattgccrtgtctttgaaaagtct

SEQ ID NO: 3014 - DNA, 33 bp, homo sapien
tgactaaactgggcatyttgagttttagcttca

SEQ ID NO: 3015 - DNA, 33 bp, homo sapien
agtgttagtgcattctrtgtatggcccaagaca

SEQ ID NO: 3016 - DNA, 33 bp, homo sapien
actaaatcagtatacartgggaaatcatgcctt

SEQ ID NO: 3017 - DNA, 33 bp, homo sapien
ttgggaatgcaaactgrtatagccactctggaa

SEQ ID NO: 3018 - DNA, 33 bp, homo sapien
aacttggaatctgaacycaacaggatcagttac

SEQ ID NO: 3019 - DNA, 33 bp, homo sapien
ctctctactcccaaaaracagattgcacagcac

SEQ ID NO: 3020 - DNA, 33 bp, homo sapien
acattcagtagcagacrcaattatatcccattc

SEQ ID NO: 3021 - DNA, 33 bp, homo sapien
ggaactgttgttgcctrtaactgtaagacataa

SEQ ID NO: 3022 - DNA, 33 bp, homo sapien
actcaaagaacaatgaygactataacaggcatt

SEQ ID NO: 3023 - DNA, 33 bp, homo sapien
gcacatgaacttttccmggcttttgatccatct

SEQ ID NO: 3024 - DNA, 33 bp, homo sapien
gttccagcagcactttyaacacagaaacatact

SEQ ID NO: 3025 - DNA, 33 bp, homo sapien
attgcaacttgtttggytcttcctcaacaatag

SEQ ID NO: 3026 - DNA, 33 bp, homo sapien
aaccatgtaaccttctyggtcttgtaaaatatc

SEQ ID NO: 3027 - DNA, 33 bp, homo sapien
acaacaaaagctgcaayataaccatatcagtgg

SEQ ID NO: 3028 - DNA, 33 bp, homo sapien
ttagggttaaggttttrtcatattgtacatgtg

SEQ ID NO: 3029 - DNA, 33 bp, homo sapien
ttcagtttcagttccgmctctaacttgtgatct

SEQ ID NO: 3030 - DNA, 33 bp, homo sapien
gggtctcttgctccctmctgccttgtgctccat

SEQ ID NO: 3031 - DNA, 33 bp, homo sapien
tgggaattccatttctktatatgttcatgttca

SEQ ID NO: 3032 - DNA, 33 bp, homo sapien
aattaatactccaaagsccgcttatgagattat

SEQ ID NO: 3033 - DNA, 33 bp, homo sapien
tcctcagagaaggaggrttgcattgtgaggact

SEQ ID NO: 3034 - DNA, 33 bp, homo sapien
aaatgactttgtcacgrttgtgttcactgtagt

SEQ ID NO: 3035 - DNA, 33 bp, homo sapien
cttgagcatgccttatrttccagcgagggcaag

SEQ ID NO: 3036 - DNA, 33 bp, homo sapien
cggctcagcttaccatrttttcagagttatctc

SEQ ID NO: 3037 - DNA, 33 bp, homo sapien
gcaaagccaaggtacaractcacgtgcattaaa

SEQ ID NO: 3038 - DNA, 33 bp, homo sapien
gaaaacagcacttaagscttctatatataatca

SEQ ID NO: 3039 - DNA, 33 bp, homo sapien
ctaagtgaaccctcaarcacaaaacacaagtct

SEQ ID NO: 3040 - DNA, 33 bp, homo sapien
gctgagattaaaaaaamatatgtaccacatcat

SEQ ID NO: 3041 - DNA, 33 bp, homo sapien
atattagatctgcatgyctctatattgttaatg

SEQ ID NO: 3042 - DNA, 33 bp, homo sapien
tgaccacattggctccrctgttggtcaagatca

SEQ ID NO: 3043 - DNA, 33 bp, homo sapien
atgctcttcttgctaawgtctgtacagtcatta

SEQ ID NO: 3044 - DNA, 33 bp, homo sapien
gagtggtcatgtatttrtggatttgtttctaaa

SEQ ID NO: 3045 - DNA, 33 bp, homo sapien
tctttatcaaaattccraaatataaaggcagtc

SEQ ID NO: 3046 - DNA, 33 bp, homo sapien
acttgtatatcagagcrtcaagaacactgcata

SEQ ID NO: 3047 - DNA, 33 bp, homo sapien
gtcaaataggctgcacygtactttgagatggaa

SEQ ID NO: 3048 - DNA, 33 bp, homo sapien
ctcattgatagctatgktaaaataaggaaatgt

SEQ ID NO: 3049 - DNA, 33 bp, homo sapien
ctttaatagagcctacmtaaattagagttaatg

SEQ ID NO: 3050 - DNA, 33 bp, homo sapien
ctgatctaagtcactayggcacacaggaaacta

SEQ ID NO: 3051 - DNA, 33 bp, homo sapien
ggctggtcaaactgccrcctcagggcaaatgcg

SEQ ID NO: 3052 - DNA, 33 bp, homo sapien
tgcctggattatcaggwttatcacaattgcctc

SEQ ID NO: 3053 - DNA, 33 bp, homo sapien
atagcatcccagagccygaatttctgaggctta

SEQ ID NO: 3054 - DNA, 33 bp, homo sapien
ctatgtgagcgggacastgagttcttccccagt

SEQ ID NO: 3055 - DNA, 33 bp, homo sapien
tccagaaatagctgcawagttacaaattaagga

SEQ ID NO: 3056 - DNA, 33 bp, homo sapien
cgagcagccagactttktgctggttacagttca

SEQ ID NO: 3057 - DNA, 33 bp, homo sapien
cttggctctccagtgtrtgtaatgctggtgaca

SEQ ID NO: 3058 - DNA, 33 bp, homo sapien
cacctgtgcttcaccayatcttgacaacattat

SEQ ID NO: 3059 - DNA, 33 bp, homo sapien
aaggatttgccataatmtaaggaaaaatgatgt

SEQ ID NO: 3060 - DNA, 33 bp, homo sapien
ttactagaattatgctsatattacaggtgagga

SEQ ID NO: 3061 - DNA, 33 bp, homo sapien
agagtataagattgccrgatatggaacatttaa

SEQ ID NO: 3062 - DNA, 33 bp, homo sapien
tgctgtggatgttcaaygttgcaatactgtttg

SEQ ID NO: 3063 - DNA, 33 bp, homo sapien
cagaggtttgccctagmgtaggtatcatcagaa

SEQ ID NO: 3064 - DNA, 33 bp, homo sapien
ccacctgtcttctgtaygtaagccactatgtaa

SEQ ID NO: 3065 - DNA, 33 bp, homo sapien
ctttgtttcaaggttartaccctgatagtgtta

SEQ ID NO: 3066 - DNA, 33 bp, homo sapien
cttttctgaagaatgckttgggccagtgttcta

SEQ ID NO: 3067 - DNA, 33 bp, homo sapien
agtatgtgttcatatcrtaaacattatccacct

SEQ ID NO: 3068 - DNA, 33 bp, homo sapien
gagagctactagagacrttgctggcatgcagtc

SEQ ID NO: 3069 - DNA, 33 bp, homo sapien
acgctgaaattcgttgwctcgtactgtgctaag

SEQ ID NO: 3070 - DNA, 33 bp, homo sapien
tctggtggttatgatcmgcatgtacccgccaat

SEQ ID NO: 3071 - DNA, 33 bp, homo sapien
gacagcaccctggagtrcttcaacatttagaga

SEQ ID NO: 3072 - DNA, 33 bp, homo sapien
acatctttgatttgtawacttgtggtaattttc

SEQ ID NO: 3073 - DNA, 33 bp, homo sapien
tggaagctccgccatcytgagttcctgtgtgac

SEQ ID NO: 3074 - DNA, 33 bp, homo sapien
gtaaggcaaagaacacrcagctacagggacaaa

SEQ ID NO: 3075 - DNA, 33 bp, homo sapien
ggtagggtagacctgayagcaactggaactctc

SEQ ID NO: 3076 - DNA, 33 bp, homo sapien
gggatttgagaggacartaagtacaggcactgg

SEQ ID NO: 3077 - DNA, 33 bp, homo sapien
aggatgtggctatttaytgaacaggaatgaaag

SEQ ID NO: 3078 - DNA, 33 bp, homo sapien
gtctttatgactctcaygtacacacctatcagc

SEQ ID NO: 3079 - DNA, 33 bp, homo sapien
ctgaaaaggccagagamaaatgtgacctaagaa

SEQ ID NO: 3080 - DNA, 33 bp, homo sapien
tgtttttgtttccctgkttttctactatgattg

SEQ ID NO: 3081 - DNA, 33 bp, homo sapien
agaataatacactacarttgagcacatttgtcc

SEQ ID NO: 3082 - DNA, 33 bp, homo sapien
ctttcccattctccacrtggtagtggctcactc

SEQ ID NO: 3083 - DNA, 33 bp, homo sapien
ggatatgagctggaatycgacttttcttgccct

SEQ ID NO: 3084 - DNA, 33 bp, homo sapien
aaaatctaggaaaaaargaacacaataaactca

SEQ ID NO: 3085 - DNA, 33 bp, homo sapien
tagatagctgacatttkattctcctctaagaaa

SEQ ID NO: 3086 - DNA, 33 bp, homo sapien
tctaatagagttcaaaraaatcaagatagctta

SEQ ID NO: 3087 - DNA, 33 bp, homo sapien
tgacagccctagtaagygtggattcactgggtt

SEQ ID NO: 3088 - DNA, 33 bp, homo sapien
cagggacacgtgtgacygctgaaattaacatct

SEQ ID NO: 3089 - DNA, 33 bp, homo sapien
tttgaatttccctaacrttaagcatttttgcta

SEQ ID NO: 3090 - DNA, 33 bp, homo sapien
tggcatgttataatttmattggcagcattattt

SEQ ID NO: 3091 - DNA, 33 bp, homo sapien
tgcatgcccaaatcacrgtatgcgatagtgcac

SEQ ID NO: 3092 - DNA, 33 bp, homo sapien
cctagactcaccatacraggagaagttccttga

SEQ ID NO: 3093 - DNA, 33 bp, homo sapien
ttaagaggagagagacyatacaacttttggcag

SEQ ID NO: 3094 - DNA, 33 bp, homo sapien
cttgaaaagtggctatyggccaggaatctgaca

SEQ ID NO: 3095 - DNA, 33 bp, homo sapien
ctcatctttaatatackgttagtgtgtgagtag

SEQ ID NO: 3096 - DNA, 33 bp, homo sapien
agtgtgaaaaattgtgygaaattaatattggca

SEQ ID NO: 3097 - DNA, 33 bp, homo sapien
aacttgacaaaggtagyggtcagctgtggtatc

SEQ ID NO: 3098 - DNA, 33 bp, homo sapien
gtaggggagatttctcyacctttagctgcctat

SEQ ID NO: 3099 - DNA, 33 bp, homo sapien
tgttgggatcctggctyagttaatgagaacacc

SEQ ID NO: 3100 - DNA, 33 bp, homo sapien
aatacctgattagccasaataacacattctcag

SEQ ID NO: 3101 - DNA, 33 bp, homo sapien
taaggagtatacattgsacttgatgtctattgt

SEQ ID NO: 3102 - DNA, 33 bp, homo sapien
gaggtgagtccttggcygccggacagggcataa

SEQ ID NO: 3103 - DNA, 33 bp, homo sapien
gtgtgatgatgttccastaaggatgggtgcagc

SEQ ID NO: 3104 - DNA, 33 bp, homo sapien
attttctgtggacagaytcaagccagctgcaga

SEQ ID NO: 3105 - DNA, 33 bp, homo sapien
taccatctctgctttaytgtgaaaatgtataaa

SEQ ID NO: 3106 - DNA, 33 bp, homo sapien
aagtgggtctgtgtctmcacataaaggatatag

SEQ ID NO: 3107 - DNA, 33 bp, homo sapien
gggatagtcagatactmggcaagaaccaggaac

SEQ ID NO: 3108 - DNA, 33 bp, homo sapien
tcaatatcaagaataaycccataaacaagcaat

SEQ ID NO: 3109 - DNA, 33 bp, homo sapien
cactgctataggtaaakggacatactaatttgt

SEQ ID NO: 3110 - DNA, 33 bp, homo sapien
aagtgctcagtaactgygtgtgactaatggctc

SEQ ID NO: 3111 - DNA, 33 bp, homo sapien
tagtaaccgccagccakgtttgagcacctctga

SEQ ID NO: 3112 - DNA, 33 bp, homo sapien
catttaccgtggctttkgtacatgctccttcgt

SEQ ID NO: 3113 - DNA, 33 bp, homo sapien
gtattgtggaatgagaraggacttgtttgtctg

SEQ ID NO: 3114 - DNA, 33 bp, homo sapien
aagaacttgtagtcaaytggagaagacagacaa

SEQ ID NO: 3115 - DNA, 33 bp, homo sapien
cccaaacgaggacacakggtctgacactaggct

SEQ ID NO: 3116 - DNA, 33 bp, homo sapien
cagccacatttatgatytcacagttctgcagcc

SEQ ID NO: 3117 - DNA, 33 bp, homo sapien
ccattacccataatatyattttttgcagtgttt

SEQ ID NO: 3118 - DNA, 33 bp, homo sapien
gtcgcatgacatattcraagtgctaaaaggaaa

SEQ ID NO: 3119 - DNA, 33 bp, homo sapien
aattaaaaacaacacakgacgaagagattaatg

SEQ ID NO: 3120 - DNA, 33 bp, homo sapien
tctcttcttcaaccttsgctttctggccttgaa

SEQ ID NO: 3121 - DNA, 33 bp, homo sapien
ggccagattactagccygggtgcccaacagcag

SEQ ID NO: 3122 - DNA, 33 bp, homo sapien
cagggattgaatctcasgttaataggacagtag

SEQ ID NO: 3123 - DNA, 33 bp, homo sapien
tctgaaggaccctaackaatacacctcccctcc

SEQ ID NO: 3124 - DNA, 33 bp, homo sapien
atctttcctcaaatccrttaaatttttccatct

SEQ ID NO: 3125 - DNA, 33 bp, homo sapien
acggggtgagatattgrtgtattagtagacctt

SEQ ID NO: 3126 - DNA, 33 bp, homo sapien
caaggacaaagcactayactggctctcgtgtag

SEQ ID NO: 3127 - DNA, 33 bp, homo sapien
tggtagttcctatgaarcagagaatttcaatgg

SEQ ID NO: 3128 - DNA, 33 bp, homo sapien
aaccgtattcagatttycccagttgctcaaaaa

SEQ ID NO: 3129 - DNA, 33 bp, homo sapien
ttatttccaaacttcaygatcgggtagtattac

SEQ ID NO: 3130 - DNA, 33 bp, homo sapien
ggaagatttttccatgrgagagaaaaaaacaga

SEQ ID NO: 3131 - DNA, 33 bp, homo sapien
attttacttttaaaatwctagtgctacaaagaa

SEQ ID NO: 3132 - DNA, 33 bp, homo sapien
cacagcaagatgactayagatgccataagcctg

SEQ ID NO: 3133 - DNA, 33 bp, homo sapien
atttacaagcatgtgcrtgagtctgtgtaccct

SEQ ID NO: 3134 - DNA, 33 bp, homo sapien
aaagtgtttaggagatsactataggcaaagctt

SEQ ID NO: 3135 - DNA, 33 bp, homo sapien
gggtttaaatacgagtytgtgaaattcaagctt

SEQ ID NO: 3136 - DNA, 33 bp, homo sapien
aataagtgatttctttyggtgacaaagtcacaa

SEQ ID NO: 3137 - DNA, 33 bp, homo sapien
tgttaaagtcttttagyccatcttaaaattggg

SEQ ID NO: 3138 - DNA, 33 bp, homo sapien
agagtaataaatttggyggacataggcaaaata

SEQ ID NO: 3139 - DNA, 33 bp, homo sapien
gatccatagctgctctsaaacatacgctagaaa

SEQ ID NO: 3140 - DNA, 33 bp, homo sapien
caagcatcacaaacatytaagtttctaagcaac

SEQ ID NO: 3141 - DNA, 33 bp, homo sapien
tagagcaagaacaattmgtggcatgagcccatg

SEQ ID NO: 3142 - DNA, 33 bp, homo sapien
gaaaaatggtcaacacmtcataaatgatttcat

SEQ ID NO: 3143 - DNA, 33 bp, homo sapien
tgtcagcttcatatgcyggaaattaagagtgac

SEQ ID NO: 3144 - DNA, 33 bp, homo sapien
cccaataatattctgcstattgctctccatctt

SEQ ID NO: 3145 - DNA, 33 bp, homo sapien
tcattatttgcatagtrtactcatttgagcaag

SEQ ID NO: 3146 - DNA, 33 bp, homo sapien
ttaccaaataattaagracaccagcaacaacaa

SEQ ID NO: 3147 - DNA, 33 bp, homo sapien
cagagaaagagcatcaratgtgctttgaacata

SEQ ID NO: 3148 - DNA, 33 bp, homo sapien
caggaacttggtgagcrtcatcactaaggccat

SEQ ID NO: 3149 - DNA, 33 bp, homo sapien
ctgatctcagtcatcargaacaactagaaatta

SEQ ID NO: 3150 - DNA, 33 bp, homo sapien
tagcctcctttctctcrtagtcagggttcttgg

SEQ ID NO: 3151 - DNA, 33 bp, homo sapien
gctgttgattgccagcrggtcagaaccctgtga

SEQ ID NO: 3152 - DNA, 33 bp, homo sapien
acatttattccatgcamgaccatacaagtgagg

SEQ ID NO: 3153 - DNA, 33 bp, homo sapien
actgtgagtaaagtacrttcttagggcacagaa

SEQ ID NO: 3154 - DNA, 33 bp, homo sapien
atgagtcatgggtcaaygtccttctccacaaca

SEQ ID NO: 3155 - DNA, 33 bp, homo sapien
tatcatggcactcagtstggtgggtattactgt

SEQ ID NO: 3156 - DNA, 33 bp, homo sapien
caacattttaacattcyaaacatgaatcagttc

SEQ ID NO: 3157 - DNA, 33 bp, homo sapien
actattgactggaacgyttttggccgacatgat

SEQ ID NO: 3158 - DNA, 33 bp, homo sapien
gggctgctgtgtagaaytgataatatggacttt

SEQ ID NO: 3159 - DNA, 33 bp, homo sapien
agaaagccgatgattamcaccaggtcaggggac

SEQ ID NO: 3160 - DNA, 33 bp, homo sapien
tttctctagacattacyggactcactaacgcag

SEQ ID NO: 3161 - DNA, 33 bp, homo sapien
catgaacttacaagcaygaagcacaaagttcat

SEQ ID NO: 3162 - DNA, 33 bp, homo sapien
tacatcagtgctgttcrtgactcaatttcggtt

SEQ ID NO: 3163 - DNA, 33 bp, homo sapien
tatattgccactatttmtttttctgatagcact

SEQ ID NO: 3164 - DNA, 33 bp, homo sapien
tacattccacttccgayggactacagctctgct

SEQ ID NO: 3165 - DNA, 33 bp, homo sapien
ctagaaattgaacttaygcaaagcttcatctga

SEQ ID NO: 3166 - DNA, 33 bp, homo sapien
gaagttcttctatggcyggcatgactcagcaag

SEQ ID NO: 3167 - DNA, 33 bp, homo sapien
aattttctaaatgctgmatagctccccttgaag

SEQ ID NO: 3168 - DNA, 33 bp, homo sapien
aagatattcaaagagcyacgaagagaaaatggt

SEQ ID NO: 3169 - DNA, 33 bp, homo sapien
tggcttaatgatccatrtactgtcacggcacct

SEQ ID NO: 3170 - DNA, 33 bp, homo sapien
atatggtgactgataaytacccactctcagtcc

SEQ ID NO: 3171 - DNA, 33 bp, homo sapien
gagcttacagtctagtygggttagatagaaata

SEQ ID NO: 3172 - DNA, 33 bp, homo sapien
ttttatgcattttgacyatcttttacactactt

SEQ ID NO: 3173 - DNA, 33 bp, homo sapien
aacaaaacactcttaayaagcttgagataaaag

SEQ ID NO: 3174 - DNA, 33 bp, homo sapien
gcagtccaatcacaccrtattgtttctgatgta

SEQ ID NO: 3175 - DNA, 33 bp, homo sapien
tgtgaaagttgtatgarattatatgaaattcac

SEQ ID NO: 3176 - DNA, 33 bp, homo sapien
ctcctccaaaccatagmcttcgtagtatgtatt

SEQ ID NO: 3177 - DNA, 33 bp, homo sapien
cttcactaccactctcytgatctttcagtggtt

SEQ ID NO: 3178 - DNA, 33 bp, homo sapien
gagtagatctataccarttcccacaggttaagg

SEQ ID NO: 3179 - DNA, 33 bp, homo sapien
cccacagagcacaaaarcaatcatcagcctgta

SEQ ID NO: 3180 - DNA, 33 bp, homo sapien
ttttggcctgaaacatsgttcatggtgactaat

SEQ ID NO: 3181 - DNA, 33 bp, homo sapien
ttccagtggcaggtcayttgcaaattttcttaa

SEQ ID NO: 3182 - DNA, 33 bp, homo sapien
agagtaacactgcatarttgacctgattcaagg

SEQ ID NO: 3183 - DNA, 33 bp, homo sapien
acccactatgaggccayggaaagggtggatatg

SEQ ID NO: 3184 - DNA, 33 bp, homo sapien
gagcagggcatcaggcyagctgcaaatcgctct

SEQ ID NO: 3185 - DNA, 33 bp, homo sapien
caaccatttggaaattrtgttttactcattttt

SEQ ID NO: 3186 - DNA, 33 bp, homo sapien
caaaaggtgatagaagraaaagacatatgggtc

SEQ ID NO: 3187 - DNA, 33 bp, homo sapien
agaccctaattttaagygatctacagtctggtg

SEQ ID NO: 3188 - DNA, 33 bp, homo sapien
agaacaacactttcccratatccctggaggaaa

SEQ ID NO: 3189 - DNA, 33 bp, homo sapien
cctacctcagggcctgwcttggcatccaaccag

SEQ ID NO: 3190 - DNA, 33 bp, homo sapien
taaacatctcaaaaccraagttcgctttctaga

SEQ ID NO: 3191 - DNA, 33 bp, homo sapien
aacagctttaagtctawgtagaagcgacgtagc

SEQ ID NO: 3192 - DNA, 33 bp, homo sapien
caattagacctcatcasttttccccaacattaa

SEQ ID NO: 3193 - DNA, 33 bp, homo sapien
gataagtctcaaatccwtttccttgacccacta

SEQ ID NO: 3194 - DNA, 33 bp, homo sapien
gaaacaggctagtgctmaaagcaaagtgaaagg

SEQ ID NO: 3195 - DNA, 33 bp, homo sapien
ccccctaagtatgcagmgaaaggaaatgtctgt

SEQ ID NO: 3196 - DNA, 33 bp, homo sapien
actgacattcatatttyttaaactagcctgaca

SEQ ID NO: 3197 - DNA, 33 bp, homo sapien
taagaaatatctcatgygtagtatgtaaatcag

SEQ ID NO: 3198 - DNA, 33 bp, homo sapien
cccagccaaccaggagmagcctcagcataggct

SEQ ID NO: 3199 - DNA, 33 bp, homo sapien
tttaagtgtaagccaaygattttatacccagcc

SEQ ID NO: 3200 - DNA, 33 bp, homo sapien
tgttttgaatgcatttyggccatgaggttaaag

SEQ ID NO: 3201 - DNA, 33 bp, homo sapien
gatgggagcaagaacayttgtcatcacccgctt

SEQ ID NO: 3202 - DNA, 33 bp, homo sapien
acaaaggaatgaatagrtagaggacaaagattt

SEQ ID NO: 3203 - DNA, 33 bp, homo sapien
atgcaaatgtgtttccrctaactccatgcaaaa

SEQ ID NO: 3204 - DNA, 33 bp, homo sapien
ataagaacataaattgytattcctcttcaaaat

SEQ ID NO: 3205 - DNA, 33 bp, homo sapien
gtctgggcgtggagaaragatgttcctgaaact

SEQ ID NO: 3206 - DNA, 33 bp, homo sapien
gaatcaccagcttaggyggctatagagtgcttg

SEQ ID NO: 3207 - DNA, 33 bp, homo sapien
gtccaatcagcccggarcttctgatgaatttgt

SEQ ID NO: 3208 - DNA, 33 bp, homo sapien
aaccaaaatcatgtccrtttaatagcagtatct

SEQ ID NO: 3209 - DNA, 33 bp, homo sapien
cctggctcagagcttgycaggtagtgagtgcct

SEQ ID NO: 3210 - DNA, 33 bp, homo sapien
aaagagggctgccattstctctgttgtgctttc

SEQ ID NO: 3211 - DNA, 33 bp, homo sapien
cagttgaatgaggagaygaacaaggcctatatt

SEQ ID NO: 3212 - DNA, 33 bp, homo sapien
catctgactgagaaatkatccttggactataaa

SEQ ID NO: 3213 - DNA, 33 bp, homo sapien
tcattattacaagaggrccttttgcttaatttg

SEQ ID NO: 3214 - DNA, 33 bp, homo sapien
ttcaaaaatgtgtctgsaaatataaagttacag

SEQ ID NO: 3215 - DNA, 33 bp, homo sapien
tgtcatctgggaagtcraatgcctctttgaatg

SEQ ID NO: 3216 - DNA, 33 bp, homo sapien
caagctgaggagaacaygctgtgctcagaaatg

SEQ ID NO: 3217 - DNA, 33 bp, homo sapien
gattaagagacgtcaayatggaaggtacagtcc

SEQ ID NO: 3218 - DNA, 33 bp, homo sapien
cttttgaaggcactgaraaaatatatatttggg

SEQ ID NO: 3219 - DNA, 33 bp, homo sapien
tgacctggaaagaaccyactgcttattttgcct

SEQ ID NO: 3220 - DNA, 33 bp, homo sapien
ataataggatcacaacyagtgaaactatccgaa

SEQ ID NO: 3221 - DNA, 33 bp, homo sapien
tgtcaatactactactytgaatttgagaatttt

SEQ ID NO: 3222 - DNA, 33 bp, homo sapien
ccaatgaaatcttacgygtactcagtttgagag

SEQ ID NO: 3223 - DNA, 33 bp, homo sapien
ttccatcatccaccagragaatgtgagtgggag

SEQ ID NO: 3224 - DNA, 33 bp, homo sapien
caaagacaacaactggstacatggcctgaacgt

SEQ ID NO: 3225 - DNA, 33 bp, homo sapien
agatttgggctttccakgtctgccttctttctt

SEQ ID NO: 3226 - DNA, 33 bp, homo sapien
ctgggtccagcattaamcagctctgaggccttg

SEQ ID NO: 3227 - DNA, 33 bp, homo sapien
tacccaagctgcaagayataatcctctttaccc

SEQ ID NO: 3228 - DNA, 33 bp, homo sapien
atatatttatttgcatrttgtggttcacccctt

SEQ ID NO: 3229 - DNA, 33 bp, homo sapien
ctacaggcaacatatcmcataattgtgcctagt

SEQ ID NO: 3230 - DNA, 33 bp, homo sapien
gtatcaagtttgacttygcaacagtgcaattat

SEQ ID NO: 3231 - DNA, 33 bp, homo sapien
ttcttttatcttattgytccagcactcggtaga

SEQ ID NO: 3232 - DNA, 33 bp, homo sapien
tctaatcttagcaaagrcagaacaagggtatta

SEQ ID NO: 3233 - DNA, 33 bp, homo sapien
gcaaaggttctcagtcmcacctggcagacttgt

SEQ ID NO: 3234 - DNA, 33 bp, homo sapien
ctggatgtattcttcaygcatcttaatatagtg

SEQ ID NO: 3235 - DNA, 33 bp, homo sapien
gtatgttttcttggtcmgggttgttgtcttagt

SEQ ID NO: 3236 - DNA, 33 bp, homo sapien
tctttgtaccttagttkttacatcttcaaagtg

SEQ ID NO: 3237 - DNA, 33 bp, homo sapien
cttttattccaatgttrcaatctctaaagttat

SEQ ID NO: 3238 - DNA, 33 bp, homo sapien
ttgtatagttttacctsttatatttcattcttg

SEQ ID NO: 3239 - DNA, 33 bp, homo sapien
catcaattgaaattcgsttccggtgccaggtga

SEQ ID NO: 3240 - DNA, 33 bp, homo sapien
gccaggctggtcacccrggaaggatggataaat

SEQ ID NO: 3241 - DNA, 33 bp, homo sapien
cccatccgctctgtcarcttctctctttccctc

SEQ ID NO: 3242 - DNA, 33 bp, homo sapien
gttattccccatattgygatggtagtagaaacc

SEQ ID NO: 3243 - DNA, 33 bp, homo sapien
agaagacaaatctaacyagaagaggagacccgg

SEQ ID NO: 3244 - DNA, 33 bp, homo sapien
ttcactcatttttaatrttttttccaattattg

SEQ ID NO: 3245 - DNA, 33 bp, homo sapien
actcatcccatttttcmagttaggttgtaaaat

SEQ ID NO: 3246 - DNA, 33 bp, homo sapien
cattgtgttggcaagtsgatatagccctatcta

SEQ ID NO: 3247 - DNA, 33 bp, homo sapien
ggtgttaccagatcttygcatgtttttcagata

SEQ ID NO: 3248 - DNA, 33 bp, homo sapien
atgtctggaaatctatsctatggtctactttga

SEQ ID NO: 3249 - DNA, 33 bp, homo sapien
aaatcagacagttctgygtaggcggccaggttt

SEQ ID NO: 3250 - DNA, 33 bp, homo sapien
tcccctcagtaagactktaccattcatcattac

SEQ ID NO: 3251 - DNA, 33 bp, homo sapien
gccagctgcctatttcrcacatacagaagacat

SEQ ID NO: 3252 - DNA, 33 bp, homo sapien
agaacatggggttgaawtgcatgctccccaagg

SEQ ID NO: 3253 - DNA, 33 bp, homo sapien
cactgaacttagaaaakactcttcaaaagataa

SEQ ID NO: 3254 - DNA, 33 bp, homo sapien
ttctcagtagtgtcaargagtttgcttttccta

SEQ ID NO: 3255 - DNA, 33 bp, homo sapien
aaacatttatttgaacyttttttgaccacaaaa

SEQ ID NO: 3256 - DNA, 33 bp, homo sapien
cctacttaggcacccargagaaaatcttgcaca

SEQ ID NO: 3257 - DNA, 33 bp, homo sapien
gggggttaggatttcartgtatgaattttgtgg

SEQ ID NO: 3258 - DNA, 33 bp, homo sapien
tccaaaataactacatkcacatactggttattg

SEQ ID NO: 3259 - DNA, 33 bp, homo sapien
tatctcagaaacagccrggatacagtgaccagg

SEQ ID NO: 3260 - DNA, 33 bp, homo sapien
attgacagacttggtcrttaaggttattggatc

SEQ ID NO: 3261 - DNA, 33 bp, homo sapien
tacttatctcaaagggyttttgtgagcactaca

SEQ ID NO: 3262 - DNA, 33 bp, homo sapien
gagtcttagttttttcrttttctacagctttcc

SEQ ID NO: 3263 - DNA, 33 bp, homo sapien
gatttatacgcaaaaaytggtaacacaagcaga

SEQ ID NO: 3264 - DNA, 33 bp, homo sapien
tatacaaataagaaagractttgagatggtgaa

SEQ ID NO: 3265 - DNA, 33 bp, homo sapien
ctaaaaatataatgtgkcccacagcagccctga

SEQ ID NO: 3266 - DNA, 33 bp, homo sapien
ccctctcctctgaagtkgtctgtttgttcttct

SEQ ID NO: 3267 - DNA, 33 bp, homo sapien
tgaattaaatatgttcyggaccccaagaaaatt

SEQ ID NO: 3268 - DNA, 33 bp, homo sapien
tattgaagcagaccatratatgatacctatatt

SEQ ID NO: 3269 - DNA, 33 bp, homo sapien
tattatccattcagggrcttatataccagtttg

SEQ ID NO: 3270 - DNA, 33 bp, homo sapien
aattgggaattgggtawacagttcttaggagtc

SEQ ID NO: 3271 - DNA, 33 bp, homo sapien
tccaactatgcctaccygattctgatagtttca

SEQ ID NO: 3272 - DNA, 33 bp, homo sapien
tcttgctaatctttttkatcctccaattcctaa

SEQ ID NO: 3273 - DNA, 33 bp, homo sapien
gctactgctgtaatatsctactcctcttctcac

SEQ ID NO: 3274 - DNA, 33 bp, homo sapien
tggagcagtttgtgggrtagttagttgtgtgca

SEQ ID NO: 3275 - DNA, 33 bp, homo sapien
ctttgctctccagcacygactttctcaccattg

SEQ ID NO: 3276 - DNA, 33 bp, homo sapien
tcatgatcaccttaaaytgaaactcgattaaaa

SEQ ID NO: 3277 - DNA, 33 bp, homo sapien
gcattacacactgcacrccatcttcctgaacaa

SEQ ID NO: 3278 - DNA, 33 bp, homo sapien
attaagatagggttgtwgtccaattatgtaact

SEQ ID NO: 3279 - DNA, 33 bp, homo sapien
ctccctggaacaacccwacaggctgtgcgtgga

SEQ ID NO: 3280 - DNA, 33 bp, homo sapien
atattttctgctaggtrgtaatttctagcactc

SEQ ID NO: 3281 - DNA, 33 bp, homo sapien
tgtctaaaggcctccamatcttcaactggaggg

SEQ ID NO: 3282 - DNA, 33 bp, homo sapien
taaaaatgatgggtgtycaaaaagtgttaacat

SEQ ID NO: 3283 - DNA, 33 bp, homo sapien
ttgggggagtttgtttmaataagttagcagagg

SEQ ID NO: 3284 - DNA, 33 bp, homo sapien
agcagaatagctgcaakgagtactgaaagcttc

SEQ ID NO: 3285 - DNA, 33 bp, homo sapien
ttctttctacaataatytgaactgtaagtggct

SEQ ID NO: 3286 - DNA, 33 bp, homo sapien
tattgccacaatctacrtgacagggatgttgca

SEQ ID NO: 3287 - DNA, 33 bp, homo sapien
agagagcaatttgacargagggtaaggtcagta

SEQ ID NO: 3288 - DNA, 33 bp, homo sapien
gggtaaattctgcttcmatgaaagtgagcgtat

SEQ ID NO: 3289 - DNA, 33 bp, homo sapien
tgggggacaagaatatkccttcccagacactat

SEQ ID NO: 3290 - DNA, 33 bp, homo sapien
agcatgaaggagaaaarcaagataaattaaaga

SEQ ID NO: 3291 - DNA, 33 bp, homo sapien
gggacatcctcagggcytactgttcagcctgcc

SEQ ID NO: 3292 - DNA, 33 bp, homo sapien
ggatgaaatttttaggyttattactttcacagg

SEQ ID NO: 3293 - DNA, 33 bp, homo sapien
aagtcacgtggtcaaayccagagaagaggggat

SEQ ID NO: 3294 - DNA, 33 bp, homo sapien
tccagtcctcagcaacyacagggaggatccagc

SEQ ID NO: 3295 - DNA, 33 bp, homo sapien
tcttgctactgatattstcttccatagcactga

SEQ ID NO: 3296 - DNA, 33 bp, homo sapien
tgggtatctcctccatyttgccatcataccaaa

SEQ ID NO: 3297 - DNA, 33 bp, homo sapien
tttaaagtcttgctaaktgtattttctgaggct

SEQ ID NO: 3298 - DNA, 33 bp, homo sapien
atggctttagagaaaargcgattggttagtttg

SEQ ID NO: 3299 - DNA, 33 bp, homo sapien
atacatagtcagaggaycttaagaaagagggat

SEQ ID NO: 3300 - DNA, 33 bp, homo sapien
acaaaagacaacacacrtagcaatttaagaaag

SEQ ID NO: 3301 - DNA, 33 bp, homo sapien
gcaaccaccaagtttayctgttatataagagca

SEQ ID NO: 3302 - DNA, 33 bp, homo sapien
agagaagtgcatacgcygaagaggcattgtgga

SEQ ID NO: 3303 - DNA, 33 bp, homo sapien
ttactcaacaagatacwtatttactcaacaagg

SEQ ID NO: 3304 - DNA, 33 bp, homo sapien
cattactgaagctgttyttagcctcttaatttt

SEQ ID NO: 3305 - DNA, 33 bp, homo sapien
tttgccagactccacawtcatgtgaaccaattc

SEQ ID NO: 3306 - DNA, 33 bp, homo sapien
cctctcagtccttgtcracaaaatggatgttaa

SEQ ID NO: 3307 - DNA, 33 bp, homo sapien
atgttgttggactgtayttcctcactccttgca

SEQ ID NO: 3308 - DNA, 33 bp, homo sapien
aaaccaaacacatcatrtcaaaatgcatgggat

SEQ ID NO: 3309 - DNA, 33 bp, homo sapien
tgaactcggatccttaraaataggaattcatcc

SEQ ID NO: 3310 - DNA, 33 bp, homo sapien
agcacttctgccgtcarttacgaagtttcaata

SEQ ID NO: 3311 - DNA, 33 bp, homo sapien
cttcttttcttattctstctaatcctgttttgg

SEQ ID NO: 3312 - DNA, 33 bp, homo sapien
acctgttaaagttctayacctcattataaacca

SEQ ID NO: 3313 - DNA, 33 bp, homo sapien
aggctgggcaggactcytctttaagcagagagc

SEQ ID NO: 3314 - DNA, 33 bp, homo sapien
gaccatttttaatgttygagtgtttctgcttcc

SEQ ID NO: 3315 - DNA, 33 bp, homo sapien
aatttgtcatttccatkttttctatttaacata

SEQ ID NO: 3316 - DNA, 33 bp, homo sapien
cagacaacatagaaaargataatcaaagtgtaa

SEQ ID NO: 3317 - DNA, 33 bp, homo sapien
gcagattatcactcaargtctcatagataggca

SEQ ID NO: 3318 - DNA, 33 bp, homo sapien
tcactagtttccattayagaggtctttcacttc

SEQ ID NO: 3319 - DNA, 33 bp, homo sapien
ccttttcaggcaagcayattacatgagtttcac

SEQ ID NO: 3320 - DNA, 33 bp, homo sapien
agttttatagtttcagsctttagaattaggtct

SEQ ID NO: 3321 - DNA, 33 bp, homo sapien
tcaccgtggtgtcgtcytcagcacccaggccaa

SEQ ID NO: 3322 - DNA, 33 bp, homo sapien
aagaagtttgcagaaaragttctgaagtcttgt

SEQ ID NO: 3323 - DNA, 33 bp, homo sapien
aagtggaaccatttttkagtgtgacttcatttc

SEQ ID NO: 3324 - DNA, 33 bp, homo sapien
ggtctgtgtgtacggcragcatttgttagaagt

SEQ ID NO: 3325 - DNA, 33 bp, homo sapien
aaccagcaagggagcarcatggcaccccagaag

SEQ ID NO: 3326 - DNA, 33 bp, homo sapien
acttcagatgaaacgartcactctaactcttat

SEQ ID NO: 3327 - DNA, 33 bp, homo sapien
tgttaataaatcttgaygaaaactttctaatga

SEQ ID NO: 3328 - DNA, 33 bp, homo sapien
ccagcaaagatgtggcracagtattcaagatta

SEQ ID NO: 3329 - DNA, 33 bp, homo sapien
aattaacctcagactasatattacagaagaaaa

SEQ ID NO: 3330 - DNA, 33 bp, homo sapien
cccctctgggaaataayagatactcatcattgt

SEQ ID NO: 3331 - DNA, 33 bp, homo sapien
atgaacgatttgtctayataagatcctgctcat

SEQ ID NO: 3332 - DNA, 33 bp, homo sapien
gcccaccatttaagtgygataatttgtcagtgt

SEQ ID NO: 3333 - DNA, 33 bp, homo sapien
cgtggcaggaaatagcstatcaccctggtacac

SEQ ID NO: 3334 - DNA, 33 bp, homo sapien
atggaaagtatggagcmtggaaaaatgggcact

SEQ ID NO: 3335 - DNA, 33 bp, homo sapien
ttagtcatgtgggagayaggagaagaagctctg

SEQ ID NO: 3336 - DNA, 33 bp, homo sapien
atcttctcatctgtccraattgtaattagcagc

SEQ ID NO: 3337 - DNA, 33 bp, homo sapien
agggagatcatcacaaractctttattctccaa

SEQ ID NO: 3338 - DNA, 33 bp, homo sapien
tacttatatatggacarctgatttgcaaccaac

SEQ ID NO: 3339 - DNA, 33 bp, homo sapien
gactacatgttgatccrtaaaaaatctaatcaa

SEQ ID NO: 3340 - DNA, 33 bp, homo sapien
agagggaaaatatttcmagaccatggtttgaag

SEQ ID NO: 3341 - DNA, 33 bp, homo sapien
aagagatgaagtcatgraagtaaccagtggaac

SEQ ID NO: 3342 - DNA, 33 bp, homo sapien
tcacattgatgatcaaytgatttttgacaagga

SEQ ID NO: 3343 - DNA, 33 bp, homo sapien
caagtgcttcttcatakcatggtaagaagacat

SEQ ID NO: 3344 - DNA, 33 bp, homo sapien
aattgtgcaccaaagtrtcatcctagttttgtg

SEQ ID NO: 3345 - DNA, 33 bp, homo sapien
ctgtatgtaaaacacartcgaagctatcaatat

SEQ ID NO: 3346 - DNA, 33 bp, homo sapien
gcgtgattgttagtgcrgatctgtggtactgct

SEQ ID NO: 3347 - DNA, 33 bp, homo sapien
gctttcccaggtgaackaaccctagctctgtct

SEQ ID NO: 3348 - DNA, 33 bp, homo sapien
tttattgactaaatgasagaacataaatgaaag

SEQ ID NO: 3349 - DNA, 33 bp, homo sapien
tcaagcctatgagtacrctttacaggccaaggc

SEQ ID NO: 3350 - DNA, 33 bp, homo sapien
tgataattctcagagaycaaagagcaagagttt

SEQ ID NO: 3351 - DNA, 33 bp, homo sapien
tgccaaatcaccctttkcaaactaatagtttct

SEQ ID NO: 3352 - DNA, 33 bp, homo sapien
atgtgctatgctgaggraaaagtgcacgcaaag

SEQ ID NO: 3353 - DNA, 33 bp, homo sapien
agaagggcatacgttgyggcaaggatggaggtc

SEQ ID NO: 3354 - DNA, 33 bp, homo sapien
catccccaagacatctsagtatgtatatgcaaa

SEQ ID NO: 3355 - DNA, 33 bp, homo sapien
ttcctctcccttcctcygtaatcattacaaaca

SEQ ID NO: 3356 - DNA, 33 bp, homo sapien
tgcagcagagcattccytactctatcctatggg

SEQ ID NO: 3357 - DNA, 33 bp, homo sapien
ctctggcttccatgtgsagaatagattgaagaa

SEQ ID NO: 3358 - DNA, 33 bp, homo sapien
tttgaacctaggctgcytggcttcagggtctat

SEQ ID NO: 3359 - DNA, 33 bp, homo sapien
atcaaaacttagaatgmtgtcacattgtccaag

SEQ ID NO: 3360 - DNA, 33 bp, homo sapien
ttgattttattttaagstaacatacacaacagg

SEQ ID NO: 3361 - DNA, 33 bp, homo sapien
gattctcccaagtctamcttgtttcatgttcac

SEQ ID NO: 3362 - DNA, 33 bp, homo sapien
agttggcttcaagacasatttaagagataagac

SEQ ID NO: 3363 - DNA, 33 bp, homo sapien
ggcctgctatctgttaygtgatgccatcctaga

SEQ ID NO: 3364 - DNA, 33 bp, homo sapien
ctacccgtgcatttatycttccagaaggtttga

SEQ ID NO: 3365 - DNA, 33 bp, homo sapien
aagtcccagacatctgrgcagcagtcctgagag

SEQ ID NO: 3366 - DNA, 33 bp, homo sapien
tgagaggaaaagcagastactgcaagaagggga

SEQ ID NO: 3367 - DNA, 33 bp, homo sapien
ttttcttttgtatcagyttcctccattatctct

SEQ ID NO: 3368 - DNA, 33 bp, homo sapien
cttctgttacgtacctrtgcttcttttaagccc

SEQ ID NO: 3369 - DNA, 33 bp, homo sapien
tgtctgcctgaacgagycatgtaaattaagttc

SEQ ID NO: 3370 - DNA, 33 bp, homo sapien
gaggaataatggctcgygtccacggttctggtt

SEQ ID NO: 3371 - DNA, 33 bp, homo sapien
atgtaagaaatgccacrggtaagctaagagcaa

SEQ ID NO: 3372 - DNA, 33 bp, homo sapien
caggttaataaagcccrattgagagagaaaagc

SEQ ID NO: 3373 - DNA, 33 bp, homo sapien
ggaagggtgattggtasaactttctattctgtc

SEQ ID NO: 3374 - DNA, 33 bp, homo sapien
ggaacattgggattgaytgcatttgtgtgttag

SEQ ID NO: 3375 - DNA, 33 bp, homo sapien
gcccaaaatggctgttygtaggaatggaaggag

SEQ ID NO: 3376 - DNA, 33 bp, homo sapien
aggagtgaatgagaaakaatttttttgcccctc

SEQ ID NO: 3377 - DNA, 33 bp, homo sapien
ccaggagaatttgtcasaaacaaacagcagtga

SEQ ID NO: 3378 - DNA, 33 bp, homo sapien
caggcctctcacctgayttctacagggctcttc

SEQ ID NO: 3379 - DNA, 33 bp, homo sapien
gacccatggaattgggytggatgtggctcagca

SEQ ID NO: 3380 - DNA, 33 bp, homo sapien
atggagcatgatctgayagaggaaactctggga

SEQ ID NO: 3381 - DNA, 33 bp, homo sapien
agttgaaggtttccagmgatcacatgtggaatc

SEQ ID NO: 3382 - DNA, 33 bp, homo sapien
tcagggggcctgcctgrtaagtcacaatgaaac

SEQ ID NO: 3383 - DNA, 33 bp, homo sapien
caagacctactgaggcrcaaactctaaggtgag

SEQ ID NO: 3384 - DNA, 33 bp, homo sapien
ctcagagggaaatatayagctgcaaatgccttt

SEQ ID NO: 3385 - DNA, 33 bp, homo sapien
gagagtaaataccgagygtaaaaaatgaatata

SEQ ID NO: 3386 - DNA, 33 bp, homo sapien
gagtccagtgacaagarggaacaagatggttta

SEQ ID NO: 3387 - DNA, 33 bp, homo sapien
aattcctgtcctggttyatctttgagtaatttg

SEQ ID NO: 3388 - DNA, 33 bp, homo sapien
aggaagtatttcatgaygtcttgaggcaggtct

SEQ ID NO: 3389 - DNA, 33 bp, homo sapien
acctcatctgctctgaygccctagggacatgtc

SEQ ID NO: 3390 - DNA, 33 bp, homo sapien
cataatactcttgatcrtatcacagattgcctg

SEQ ID NO: 3391 - DNA, 33 bp, homo sapien
ttcttatcaacacattkattctctaacgctaac

SEQ ID NO: 3392 - DNA, 33 bp, homo sapien
ctttggtgtcattgacwtggcaagacttcacaa

SEQ ID NO: 3393 - DNA, 33 bp, homo sapien
cagcgctaactggcttyccgtgccgactccacg

SEQ ID NO: 3394 - DNA, 33 bp, homo sapien
ctttttcaagctcttcrggaccaagcctgaacc

SEQ ID NO: 3395 - DNA, 33 bp, homo sapien
gagaagctaggtatgayaacagagacaaagggt

SEQ ID NO: 3396 - DNA, 33 bp, homo sapien
aatgttatatccaatgygtatgtgcaatgccaa

SEQ ID NO: 3397 - DNA, 33 bp, homo sapien
ttggttatttttttaakgcaagtattttaaaga

SEQ ID NO: 3398 - DNA, 33 bp, homo sapien
aggtggggtggaagacrctgaaatgaatttttc

SEQ ID NO: 3399 - DNA, 33 bp, homo sapien
aaggcacattcagcctkgcctatcttatctctc

SEQ ID NO: 3400 - DNA, 33 bp, homo sapien
cgttatagcacagactrgtttttcagtttatgt

SEQ ID NO: 3401 - DNA, 33 bp, homo sapien
tggaaactttttctgckcagctcatcaatattg

SEQ ID NO: 3402 - DNA, 33 bp, homo sapien
tctaagtaaactctggscccagaacaaccagga

SEQ ID NO: 3403 - DNA, 33 bp, homo sapien
aggagtttcaactacakggaaacctattctttt

SEQ ID NO: 3404 - DNA, 33 bp, homo sapien
catttttctttgccaartaaggtaacaaattca

SEQ ID NO: 3405 - DNA, 33 bp, homo sapien
aattgactaatagcacraacatcaaatcagagt

SEQ ID NO: 3406 - DNA, 33 bp, homo sapien
aacacattaatatcctwgtacctctccatcaga

SEQ ID NO: 3407 - DNA, 33 bp, homo sapien
tctttctgtgcttggtwcatttcatttggcata

SEQ ID NO: 3408 - DNA, 33 bp, homo sapien
tatagtcctatcctcayacttcctgtacatcct

SEQ ID NO: 3409 - DNA, 33 bp, homo sapien
cagtactttgcattgtrggatcagagtccccat

SEQ ID NO: 3410 - DNA, 33 bp, homo sapien
agagtttggatgaagcscagcaaattcctagct

SEQ ID NO: 3411 - DNA, 33 bp, homo sapien
caggttttaaagatgaragtgaattgagactgt

SEQ ID NO: 3412 - DNA, 33 bp, homo sapien
tcatttgttaaacttayctgataggattccaaa

SEQ ID NO: 3413 - DNA, 33 bp, homo sapien
ttggggtaagagttgastcatcattggaggact

SEQ ID NO: 3414 - DNA, 33 bp, homo sapien
tttatttctcacagtckgaaactctaagatctc

SEQ ID NO: 3415 - DNA, 33 bp, homo sapien
attgaacccgttcaggrtgaaaagagccatgaa

SEQ ID NO: 3416 - DNA, 33 bp, homo sapien
aggattgagacagatgytttagtttggaaatct

SEQ ID NO: 3417 - DNA, 33 bp, homo sapien
ctcaaaagcaagaactmcagagacagagttgtt

SEQ ID NO: 3418 - DNA, 33 bp, homo sapien
tagacagctcatagaarcagaagacatgacttt

SEQ ID NO: 3419 - DNA, 33 bp, homo sapien
tcagctactttttttcrtttccttgtgttttgt

SEQ ID NO: 3420 - DNA, 33 bp, homo sapien
ttaactaacttgccaakaatcatgcatgcagtg

SEQ ID NO: 3421 - DNA, 33 bp, homo sapien
aggaaaccgtcatttcraatacttcctcttact

SEQ ID NO: 3422 - DNA, 33 bp, homo sapien
ttttaaaaagggaagtyattatccactcctctc

SEQ ID NO: 3423 - DNA, 33 bp, homo sapien
tatgatggtgacaacaraaatgaaatggttggt

SEQ ID NO: 3424 - DNA, 33 bp, homo sapien
ggaagagtataaagttycttcttctcccttctg

SEQ ID NO: 3425 - DNA, 33 bp, homo sapien
ttgtttttcaaaatcarctatttcaagtgacag

SEQ ID NO: 3426 - DNA, 33 bp, homo sapien
cacctcagtgccgagtraagtgtgatacaaagt

SEQ ID NO: 3427 - DNA, 33 bp, homo sapien
acaaaagagaggcctaygaaaaggttccaaacc

SEQ ID NO: 3428 - DNA, 33 bp, homo sapien
aagggacatcctaaaasagcttatggacgtgga

SEQ ID NO: 3429 - DNA, 33 bp, homo sapien
aaaggacaaggcacttygtagcacaatgatatt

SEQ ID NO: 3430 - DNA, 33 bp, homo sapien
agagattaacacgtcaraataacatgaattttc

SEQ ID NO: 3431 - DNA, 33 bp, homo sapien
gactgtgtcaccatcartgcagtcgaggtgtgc

SEQ ID NO: 3432 - DNA, 33 bp, homo sapien
ggacactgctaactctrgctaaccatctcacag

SEQ ID NO: 3433 - DNA, 33 bp, homo sapien
ataaattctcaactccrtaaaagtagtaaagta

SEQ ID NO: 3434 - DNA, 33 bp, homo sapien
tggcctctttaagttargtggtattacctggac

SEQ ID NO: 3435 - DNA, 33 bp, homo sapien
agacagagggagctgcraccaatggtcaaactt

SEQ ID NO: 3436 - DNA, 33 bp, homo sapien
ttagtcaattgaatgawggctttgtggaaatcc

SEQ ID NO: 3437 - DNA, 33 bp, homo sapien
ttgcaccttgttctcaygtcttctaagagattc

SEQ ID NO: 3438 - DNA, 33 bp, homo sapien
catcatcataatatttyctgacatgtgaacatt

SEQ ID NO: 3439 - DNA, 33 bp, homo sapien
aagacaaaaaagtagamctaataagtggaaaga

SEQ ID NO: 3440 - DNA, 33 bp, homo sapien
ttgtaatagcttcaacrtaaaagtccagagtct

SEQ ID NO: 3441 - DNA, 33 bp, homo sapien
ctctatgtcaaacttcrtatcacttgacatgga

SEQ ID NO: 3442 - DNA, 33 bp, homo sapien
tgatagaagcatttctrcattaaacatgaggac

SEQ ID NO: 3443 - DNA, 33 bp, homo sapien
cagtattgtcaaaggtraaatattctgccccag

SEQ ID NO: 3444 - DNA, 33 bp, homo sapien
taacacagacccagtcrttgaagcaagcacctt

SEQ ID NO: 3445 - DNA, 33 bp, homo sapien
aggtgagaagtaagaaratgacagagttgatat

SEQ ID NO: 3446 - DNA, 33 bp, homo sapien
tattacactgcacactygtgaaacagttcctaa

SEQ ID NO: 3447 - DNA, 33 bp, homo sapien
tcagacactggttttgygggagcaggatttata

SEQ ID NO: 3448 - DNA, 33 bp, homo sapien
agtcgtttgtgcccacmgtaactccctgccttc

SEQ ID NO: 3449 - DNA, 33 bp, homo sapien
aatatgacggtccactstttacttggaatccca

SEQ ID NO: 3450 - DNA, 33 bp, homo sapien
tatttgaaattctgctwtccaacgaatcactgt

SEQ ID NO: 3451 - DNA, 33 bp, homo sapien
aactattgttgtgttakaaaggcatgtaaacac

SEQ ID NO: 3452 - DNA, 33 bp, homo sapien
gggactcgagtgcatarcattttttacttgcaa

SEQ ID NO: 3453 - DNA, 33 bp, homo sapien
agataacggagcagcaycttcgtagtgccaagg

SEQ ID NO: 3454 - DNA, 33 bp, homo sapien
cggcttcatagacatcytggcagctaagtcagc

SEQ ID NO: 3455 - DNA, 33 bp, homo sapien
ccgtattttctcaagawcctgggtttctcctct

SEQ ID NO: 3456 - DNA, 33 bp, homo sapien
gaaaaggaattttatcrtttttctgatcctacc

SEQ ID NO: 3457 - DNA, 33 bp, homo sapien
gatgttctgagttgaawttcagttagatcccaa

SEQ ID NO: 3458 - DNA, 33 bp, homo sapien
acacaaccatctttacrtcctccaggcctctag

SEQ ID NO: 3459 - DNA, 33 bp, homo sapien
cattgagcattttagartttgggtttagttaag

SEQ ID NO: 3460 - DNA, 33 bp, homo sapien
aaaatctacaaattgcycagggaaggtattttg

SEQ ID NO: 3461 - DNA, 33 bp, homo sapien
cccactcctatttgctrggcatcgaccacccaa

SEQ ID NO: 3462 - DNA, 33 bp, homo sapien
ggaagcaaagaaaataytcagttaattataagg

SEQ ID NO: 3463 - DNA, 33 bp, homo sapien
gtgtgtgccatgaaaarttctgagaagccctct

SEQ ID NO: 3464 - DNA, 33 bp, homo sapien
ggttcgacctctacgtyagcagttccatatact

SEQ ID NO: 3465 - DNA, 33 bp, homo sapien
tcatttaagctaaaacwtactaacacatgactt

SEQ ID NO: 3466 - DNA, 33 bp, homo sapien
tatgtttattagaggtytagcagaaagtggaat

SEQ ID NO: 3467 - DNA, 33 bp, homo sapien
cagaatttgatgggtakagagcaaaaaatgact

SEQ ID NO: 3468 - DNA, 33 bp, homo sapien
tctctcttatgaaaagkcatgtgattacattta

SEQ ID NO: 3469 - DNA, 33 bp, homo sapien
ctgagggatgcataatrattttccgtgaagaca

SEQ ID NO: 3470 - DNA, 33 bp, homo sapien
cgacaatttatagtcastaagcatctactatgg

SEQ ID NO: 3471 - DNA, 33 bp, homo sapien
agtgggacgattctgayttgcgtcctggaagac

SEQ ID NO: 3472 - DNA, 33 bp, homo sapien
ccccatctatacactgyccaaactcagcaaatc

SEQ ID NO: 3473 - DNA, 33 bp, homo sapien
ctcagcagtctgtatgrcctctaattcttatcc

SEQ ID NO: 3474 - DNA, 33 bp, homo sapien
agtgcagctgaaattcraacccaggtggttcta

SEQ ID NO: 3475 - DNA, 33 bp, homo sapien
atatcaaggcaaaagaytagagagtgacataaa

SEQ ID NO: 3476 - DNA, 33 bp, homo sapien
tttgaggcctttccagyggtagagttcaagagt

SEQ ID NO: 3477 - DNA, 33 bp, homo sapien
tgtataaccctttggaygcaaatgtacctgaca

SEQ ID NO: 3478 - DNA, 33 bp, homo sapien
ttctttgcccactgtckatggccaaaggcatgg

SEQ ID NO: 3479 - DNA, 33 bp, homo sapien
tcaacccttctatgccrtacttatcactgtgtt

SEQ ID NO: 3480 - DNA, 33 bp, homo sapien
ttatttgctgtaaattyctttcagggtcatgcc

SEQ ID NO: 3481 - DNA, 33 bp, homo sapien
tccacatgcccactttyatttctctagtggggt

SEQ ID NO: 3482 - DNA, 33 bp, homo sapien
tggttttctgtctgtayaacccttttgaatgga

SEQ ID NO: 3483 - DNA, 33 bp, homo sapien
aaaagccagaggatggytcccactacaaagaat

SEQ ID NO: 3484 - DNA, 33 bp, homo sapien
ataagcataagaacacsaacctccaagtttttc

SEQ ID NO: 3485 - DNA, 33 bp, homo sapien
ccaaccttgaggccaargcccatggaaccaatc

SEQ ID NO: 3486 - DNA, 33 bp, homo sapien
ctagaaatgagcccagytgaacactctatatga

SEQ ID NO: 3487 - DNA, 33 bp, homo sapien
gttaattattagactgyggcaaagccaggattc

SEQ ID NO: 3488 - DNA, 33 bp, homo sapien
caggaaattttgacacrgagctacatacacaga

SEQ ID NO: 3489 - DNA, 33 bp, homo sapien
agcatgcagattaatgracgtatttgaactgga

SEQ ID NO: 3490 - DNA, 33 bp, homo sapien
ttatgagcgagtaatcyttttaagggaaatgag

SEQ ID NO: 3491 - DNA, 33 bp, homo sapien
tgcttaaaacccacgawttgggcagtttgtaca

SEQ ID NO: 3492 - DNA, 33 bp, homo sapien
aaaagcattttgcaatyatctggaatatccaca

SEQ ID NO: 3493 - DNA, 33 bp, homo sapien
tatttaccagtcagctrcaattcagagtttacc

SEQ ID NO: 3494 - DNA, 33 bp, homo sapien
gtttgtatatctgttcrtattctgtctgcctta

SEQ ID NO: 3495 - DNA, 33 bp, homo sapien
ggaaattgctgcaggtrgagactacattttcca

SEQ ID NO: 3496 - DNA, 33 bp, homo sapien
gtgtgtttctgtaaaaytgcactgataggatcc

SEQ ID NO: 3497 - DNA, 33 bp, homo sapien
gaccatggaggtgattkcttggcttcctcagaa

SEQ ID NO: 3498 - DNA, 33 bp, homo sapien
atatccattaaactaayctttaaaagcacaggg

SEQ ID NO: 3499 - DNA, 33 bp, homo sapien
ttacacctgtatctttyttgctttgtagacaat

SEQ ID NO: 3500 - DNA, 33 bp, homo sapien
gtaattgtagttttgaytgaatttcttagtagt

SEQ ID NO: 3501 - DNA, 33 bp, homo sapien
ttgttggttggagtacwgcagaaccacaaactg

SEQ ID NO: 3502 - DNA, 33 bp, homo sapien
tacacacgtgtaagackagtacctcttcagagt

SEQ ID NO: 3503 - DNA, 33 bp, homo sapien
attgtttctttctttgrtggtagagaatattgg

SEQ ID NO: 3504 - DNA, 33 bp, homo sapien
agtgacagcataagatrgctcatttacaaagac

SEQ ID NO: 3505 - DNA, 33 bp, homo sapien
gctattttgtctacatyaacaatcatttgctta

SEQ ID NO: 3506 - DNA, 33 bp, homo sapien
atgactagatgttcagygtatttgggagagaac

SEQ ID NO: 3507 - DNA, 33 bp, homo sapien
aaccattattaatattsaatatccagatcaacc

SEQ ID NO: 3508 - DNA, 33 bp, homo sapien
atatcccctagcacaaraaagaaagccacttat

SEQ ID NO: 3509 - DNA, 33 bp, homo sapien
ccgcgggaagaaatcarcaaaggatgcacggga

SEQ ID NO: 3510 - DNA, 33 bp, homo sapien
agaaccattgccttggygtgagactgatgggag

SEQ ID NO: 3511 - DNA, 33 bp, homo sapien
aagttgggatatgtagyctgtgggatcctcaaa

SEQ ID NO: 3512 - DNA, 33 bp, homo sapien
taaagttcatgtgttaraagaagcaatattgtt

SEQ ID NO: 3513 - DNA, 33 bp, homo sapien
ccacgtctttaataatkgctacttgatccacag

SEQ ID NO: 3514 - DNA, 33 bp, homo sapien
ctgacaagattgatggytttattttctaagatg

SEQ ID NO: 3515 - DNA, 33 bp, homo sapien
tcaacaaccttaacatrtgcaaataataagcag

SEQ ID NO: 3516 - DNA, 33 bp, homo sapien
ctacattcattcatctraacactccaaaaatat

SEQ ID NO: 3517 - DNA, 33 bp, homo sapien
cttatttccttcctacrtatttgacctgttttc

SEQ ID NO: 3518 - DNA, 33 bp, homo sapien
ttggacccattgttggmgatgaggtcaggaaac

SEQ ID NO: 3519 - DNA, 33 bp, homo sapien
aacacagggttcatctrttcagtacttcagata

SEQ ID NO: 3520 - DNA, 33 bp, homo sapien
catgctggctgcagttwacacaggaaaaccggg

SEQ ID NO: 3521 - DNA, 33 bp, homo sapien
cttccttagcaatctgytactgatatagttaga

SEQ ID NO: 3522 - DNA, 33 bp, homo sapien
aagattccatggtcttkgttcattttcacccat

SEQ ID NO: 3523 - DNA, 33 bp, homo sapien
tggccatgggttttcarctgacagccttctcct

SEQ ID NO: 3524 - DNA, 33 bp, homo sapien
gttgcatgtcccctcaygggtgcaagctgaaat

SEQ ID NO: 3525 - DNA, 33 bp, homo sapien
gaggatgattgatgcaygccccttgttctcttt

SEQ ID NO: 3526 - DNA, 33 bp, homo sapien
ttaaatgaatcttttcyctttttgcttttatgc

SEQ ID NO: 3527 - DNA, 33 bp, homo sapien
caacaacagtaggttartactcagaatgtttgg

SEQ ID NO: 3528 - DNA, 33 bp, homo sapien
ataatacactggattamaacaaattgtgattaa

SEQ ID NO: 3529 - DNA, 33 bp, homo sapien
ctgaggtcacgtgataycaacaaggtgcattac

SEQ ID NO: 3530 - DNA, 33 bp, homo sapien
tctctaagaaagcctgytcttgaatcatgtact

SEQ ID NO: 3531 - DNA, 33 bp, homo sapien
tttaaaaggcaagcagwcatatattattagtgc

SEQ ID NO: 3532 - DNA, 33 bp, homo sapien
taatcaaccagacatcrcaaaccagacacagag

SEQ ID NO: 3533 - DNA, 33 bp, homo sapien
gagcccacaaggagacrgagatgattggatgac

SEQ ID NO: 3534 - DNA, 33 bp, homo sapien
ggagtttcaggaatgargctgagtcccaaggcc

SEQ ID NO: 3535 - DNA, 33 bp, homo sapien
cattttgaaagcagtcyttcctttctgagaagt

SEQ ID NO: 3536 - DNA, 33 bp, homo sapien
tattgtcattactttcraccccatctgtttcaa

SEQ ID NO: 3537 - DNA, 33 bp, homo sapien
ataggtcctcatcactrgaaacaaaaagggtcc

SEQ ID NO: 3538 - DNA, 33 bp, homo sapien
gttctgttgtttaaagwagcaaataccaagtgg

SEQ ID NO: 3539 - DNA, 33 bp, homo sapien
gtgtggatccaatggtsaccctttaggcagtgg

SEQ ID NO: 3540 - DNA, 33 bp, homo sapien
aaatcaaaaagtatacrcatattttgaaacaag

SEQ ID NO: 3541 - DNA, 33 bp, homo sapien
acacagtaattattatytccaaaccaatatcta

SEQ ID NO: 3542 - DNA, 33 bp, homo sapien
atggagatctggacatyatcagtgccagcggaa

SEQ ID NO: 3543 - DNA, 33 bp, homo sapien
ggggagggcactaaccrtcttgacttgagttct

SEQ ID NO: 3544 - DNA, 33 bp, homo sapien
caacagggttagaacaragataataatctgaaa

SEQ ID NO: 3545 - DNA, 33 bp, homo sapien
tttatgagttcagcagrtatttgactctggatt

SEQ ID NO: 3546 - DNA, 33 bp, homo sapien
cagagactgagatcaaygctttatttatcttcc

SEQ ID NO: 3547 - DNA, 33 bp, homo sapien
tgtaactatcaagcackttcatgaggagttacc

SEQ ID NO: 3548 - DNA, 33 bp, homo sapien
gcagtctatgttacatrtattcatagactgagg

SEQ ID NO: 3549 - DNA, 33 bp, homo sapien
ccacatatgtgagtatytacttcctttttagaa

SEQ ID NO: 3550 - DNA, 33 bp, homo sapien
ccaaggagggaagatcrtttgagctcagcagtt

SEQ ID NO: 3551 - DNA, 33 bp, homo sapien
aactgtgaaaggtagcrtcatcaaaacagcaat

SEQ ID NO: 3552 - DNA, 33 bp, homo sapien
cccctgaaatggtccargcaagagtttcctact

SEQ ID NO: 3553 - DNA, 33 bp, homo sapien
ccttcctcttgcctctstctgactctccatcct

SEQ ID NO: 3554 - DNA, 33 bp, homo sapien
atgatgcttaaacccawtagaagcctgaagtca

SEQ ID NO: 3555 - DNA, 33 bp, homo sapien
gttagatgaactttaaktctagctgacaaaaaa

SEQ ID NO: 3556 - DNA, 33 bp, homo sapien
ttctggaccttccttcrtaatagactcagtaat

SEQ ID NO: 3557 - DNA, 33 bp, homo sapien
taagaagtcttagaagsgttgttttttctacca

SEQ ID NO: 3558 - DNA, 33 bp, homo sapien
ttctttaatcttatccrtgaccttttttgcccc

SEQ ID NO: 3559 - DNA, 33 bp, homo sapien
cttgtgtgcttaaatgrtgcgggctcatgagga

SEQ ID NO: 3560 - DNA, 33 bp, homo sapien
tgagtcatagctttcaygacaataaaatggata

SEQ ID NO: 3561 - DNA, 33 bp, homo sapien
cgtttgttaggttgcastgtcctccttggaagc

SEQ ID NO: 3562 - DNA, 33 bp, homo sapien
tagctcagcagagacaygtttcctgaatttatg

SEQ ID NO: 3563 - DNA, 33 bp, homo sapien
caccaacattctgaacmgtaccatttagatgtt

SEQ ID NO: 3564 - DNA, 33 bp, homo sapien
tgtattacatttgctcrgcatcttgcctgtgct

SEQ ID NO: 3565 - DNA, 33 bp, homo sapien
ttctaagggtatgcttmaattattgctataagg

SEQ ID NO: 3566 - DNA, 33 bp, homo sapien
tcaagagctcattcctygggatttaataagttt

SEQ ID NO: 3567 - DNA, 33 bp, homo sapien
aaagcacaatgcctaaygcagagtaaacattca

SEQ ID NO: 3568 - DNA, 33 bp, homo sapien
ctacttagttcagagtygctctttgaccatcta

SEQ ID NO: 3569 - DNA, 33 bp, homo sapien
gccatatgctgtcaatkgtcaacactcttagta

SEQ ID NO: 3570 - DNA, 33 bp, homo sapien
acatgcggtttacaaayattttctcacgatctg

SEQ ID NO: 3571 - DNA, 33 bp, homo sapien
atgtgggtgtctacttwtgctaggtgtcgggaa

SEQ ID NO: 3572 - DNA, 33 bp, homo sapien
tttgcttgtttcttaawtgggttgcttttttat

SEQ ID NO: 3573 - DNA, 33 bp, homo sapien
cacagttctccatctcrtcccttggtcttaacc

SEQ ID NO: 3574 - DNA, 33 bp, homo sapien
tttatggttgaattccyggaaatatgtagaaat

SEQ ID NO: 3575 - DNA, 33 bp, homo sapien
tcttgccttttcagctkcttctggctataggta

SEQ ID NO: 3576 - DNA, 33 bp, homo sapien
atgttgactactttgasgtttctcaaacaaagg

SEQ ID NO: 3577 - DNA, 33 bp, homo sapien
aaatggtaaagaaaggrcatgcgagtgagaaaa

SEQ ID NO: 3578 - DNA, 33 bp, homo sapien
tcaaagggcataagcamatgtcaaataattgaa

SEQ ID NO: 3579 - DNA, 33 bp, homo sapien
gtctgaatttggtgctstaagaaccaagaaaac

SEQ ID NO: 3580 - DNA, 33 bp, homo sapien
caaagccaagataacamctctatcatttgataa

SEQ ID NO: 3581 - DNA, 33 bp, homo sapien
ccactccaaaacataayggctaaagccacaaaa

SEQ ID NO: 3582 - DNA, 33 bp, homo sapien
gctatgtccagctgctrtcatcacacactacac

SEQ ID NO: 3583 - DNA, 33 bp, homo sapien
taaagaaatagccaacycacactaaagcatgtt

SEQ ID NO: 3584 - DNA, 33 bp, homo sapien
aagttcctaagattcawcttcctctgtttaaat

SEQ ID NO: 3585 - DNA, 33 bp, homo sapien
gggcaaaatgttaccaygcctcgacagcccctg

SEQ ID NO: 3586 - DNA, 33 bp, homo sapien
ggggtggagacaaatayaggaacccagttgaca

SEQ ID NO: 3587 - DNA, 33 bp, homo sapien
tcctacagccccttagrtttcgttgcactatca

SEQ ID NO: 3588 - DNA, 33 bp, homo sapien
agtgatggtagatatgrctcttttttggcttat

SEQ ID NO: 3589 - DNA, 33 bp, homo sapien
tagctttcgaagaagcrcagatgtccagaaaga

SEQ ID NO: 3590 - DNA, 33 bp, homo sapien
tcacacacaaattacaygaagagtgtttattac

SEQ ID NO: 3591 - DNA, 33 bp, homo sapien
caccatactgtaagcaraattccacgctcattc

SEQ ID NO: 3592 - DNA, 33 bp, homo sapien
atcctccttacaacttyatttctccctgcagac

SEQ ID NO: 3593 - DNA, 33 bp, homo sapien
aatttatggtaagagakacttttctaacaatat

SEQ ID NO: 3594 - DNA, 33 bp, homo sapien
tcttgggttttgctcartgtagtcactttgtct

SEQ ID NO: 3595 - DNA, 33 bp, homo sapien
ttctgaaactactgtcsttgttgttcaaaaagc

SEQ ID NO: 3596 - DNA, 33 bp, homo sapien
ctcatcattcatctttrttctcaatctaattca

SEQ ID NO: 3597 - DNA, 33 bp, homo sapien
agaaattctaaggtacrgtaacaacatgcctcc

SEQ ID NO: 3598 - DNA, 33 bp, homo sapien
ttttgcagctatgattrtggatattgagatggg

SEQ ID NO: 3599 - DNA, 33 bp, homo sapien
gccatttatctttctaygcctctgtttgctcat

SEQ ID NO: 3600 - DNA, 33 bp, homo sapien
ccctggaaaatgcctakgagtgaacaggttggg

SEQ ID NO: 3601 - DNA, 33 bp, homo sapien
tcacaatgaagtaccaytttaacccaccagact

SEQ ID NO: 3602 - DNA, 33 bp, homo sapien
aggggcctgtctaggcygcccaaattgctggga

SEQ ID NO: 3603 - DNA, 33 bp, homo sapien
agactttcttttgcttygggcaatatcctaaga

SEQ ID NO: 3604 - DNA, 33 bp, homo sapien
tgttgtatggatatttkgcatgatatattgaag

SEQ ID NO: 3605 - DNA, 33 bp, homo sapien
acatcactgtggctgcrgcaccgccactcagga

SEQ ID NO: 3606 - DNA, 33 bp, homo sapien
agagaattagagtaagygtacatctaaagtgct

SEQ ID NO: 3607 - DNA, 33 bp, homo sapien
ttaccttgacatttttrtagctaaatctctttc

SEQ ID NO: 3608 - DNA, 33 bp, homo sapien
acacagtagatgactcycctttcttcttagtac

SEQ ID NO: 3609 - DNA, 33 bp, homo sapien
ggaaccagctgatgatrttcaaggatgtttttt

SEQ ID NO: 3610 - DNA, 33 bp, homo sapien
agtctaaactgaggatyattcacctgaagagat

SEQ ID NO: 3611 - DNA, 33 bp, homo sapien
actaaatctgaacttaygactacatgggttctt

SEQ ID NO: 3612 - DNA, 33 bp, homo sapien
ttttccaaatggctcayggttggagtctgtttt

SEQ ID NO: 3613 - DNA, 33 bp, homo sapien
tacttattctcttaacrattttctcccctaact

SEQ ID NO: 3614 - DNA, 33 bp, homo sapien
ctattttgtagcatcamttgtttcatttcctct

SEQ ID NO: 3615 - DNA, 33 bp, homo sapien
tccaaaatgtgattcaratataatctcctgaaa

SEQ ID NO: 3616 - DNA, 33 bp, homo sapien
aggtaatgaacaaatgraaaatatgtttcccag

SEQ ID NO: 3617 - DNA, 33 bp, homo sapien
ccacctacttcctagakctgttgtaaggcttaa

SEQ ID NO: 3618 - DNA, 33 bp, homo sapien
cagccgtctctccatgrcttggtgctcatgttt

SEQ ID NO: 3619 - DNA, 33 bp, homo sapien
ccacttaattttctgckcttagaatgctcctgc

SEQ ID NO: 3620 - DNA, 33 bp, homo sapien
cattatctgcctactgytcaaactcagcgataa

SEQ ID NO: 3621 - DNA, 33 bp, homo sapien
aagggttgacacagaawtacagacccagtaaaa

SEQ ID NO: 3622 - DNA, 33 bp, homo sapien
aatccaagatataattkcacaaacatgtacaag

SEQ ID NO: 3623 - DNA, 33 bp, homo sapien
aatcagtgaaaactacsgaaaacacaaatttgg

SEQ ID NO: 3624 - DNA, 33 bp, homo sapien
tgaactgacactgtttsgttccacacggtatct

SEQ ID NO: 3625 - DNA, 33 bp, homo sapien
agtaacactcctaacayggcaagaaagtaggct

SEQ ID NO: 3626 - DNA, 33 bp, homo sapien
ggagcaattttttgtakgtcaattatacctcag

SEQ ID NO: 3627 - DNA, 33 bp, homo sapien
agatgagctgcccctcrtcttcgcagaacaggt

SEQ ID NO: 3628 - DNA, 33 bp, homo sapien
gtggtactttgtatttyaatcattttgattaaa

SEQ ID NO: 3629 - DNA, 33 bp, homo sapien
atagcacagagaaatargaaccaggatgaaatg

SEQ ID NO: 3630 - DNA, 33 bp, homo sapien
gagagtgacagaaaaaygccaggacccaagaga

SEQ ID NO: 3631 - DNA, 33 bp, homo sapien
agcttttcatcagccawaaagaaagaatctgat

SEQ ID NO: 3632 - DNA, 33 bp, homo sapien
caagaagagtctcacaytttctttcagggtata

SEQ ID NO: 3633 - DNA, 33 bp, homo sapien
gagcaactgcaggattygggcagccaggatctg

SEQ ID NO: 3634 - DNA, 33 bp, homo sapien
cacttttctatagttaytgaacattgaatatct

SEQ ID NO: 3635 - DNA, 33 bp, homo sapien
gaaatttaattttcacrtcacagtaataagagt

SEQ ID NO: 3636 - DNA, 33 bp, homo sapien
aatcacacgtttctccygtgctcactctctctt

SEQ ID NO: 3637 - DNA, 33 bp, homo sapien
gatggacacccaaataygctggcttgatcatta

SEQ ID NO: 3638 - DNA, 33 bp, homo sapien
tagacctgtagaggagrcatttcccataccttt

SEQ ID NO: 3639 - DNA, 33 bp, homo sapien
aacaggagagaagtttrtatatctgtctccaaa

SEQ ID NO: 3640 - DNA, 33 bp, homo sapien
tccccaggtctgatttractcacctttctccct

SEQ ID NO: 3641 - DNA, 33 bp, homo sapien
tattatttgttcattarggtgattattggattg

SEQ ID NO: 3642 - DNA, 33 bp, homo sapien
actcattctttccttaytgcaggacttcagttt

SEQ ID NO: 3643 - DNA, 33 bp, homo sapien
aatacaagctgacaagraaaaagcatttcaaat

SEQ ID NO: 3644 - DNA, 33 bp, homo sapien
tccagcgatctgcaacwtttcatttaatatttg

SEQ ID NO: 3645 - DNA, 33 bp, homo sapien
tgaggttgggagaggtraagtgatctctcatgg

SEQ ID NO: 3646 - DNA, 33 bp, homo sapien
tccctgttgattcactraacaaatgcctcagtt

SEQ ID NO: 3647 - DNA, 33 bp, homo sapien
acccagtagaggctagkgtcctccatttaagcc

SEQ ID NO: 3648 - DNA, 33 bp, homo sapien
gaaggggcaggccacasagaatggtctccctgg

SEQ ID NO: 3649 - DNA, 33 bp, homo sapien
aaatgtaattttaaacratcaaacatggactta

SEQ ID NO: 3650 - DNA, 33 bp, homo sapien
atagatgtaaagcttcrttttttttcctcagaa

SEQ ID NO: 3651 - DNA, 33 bp, homo sapien
ctaaactactgtgccawtgtattaaccagtatc

SEQ ID NO: 3652 - DNA, 33 bp, homo sapien
aatgcacttgagtgaaygggtgaaaaacaacac

SEQ ID NO: 3653 - DNA, 33 bp, homo sapien
taagtgtaaacttagcyggaaagcccacatagc

SEQ ID NO: 3654 - DNA, 33 bp, homo sapien
aaggctttaggtctttsgtaccaaacattctat

SEQ ID NO: 3655 - DNA, 33 bp, homo sapien
cataattggttcaatcrtccgtctactattgga

SEQ ID NO: 3656 - DNA, 33 bp, homo sapien
gccacacctgcacagtyggcagtctgtgtctct

SEQ ID NO: 3657 - DNA, 33 bp, homo sapien
ttgtgacttcctaacamtaaaccacattctagt

SEQ ID NO: 3658 - DNA, 33 bp, homo sapien
gctctataattcttcarctaaggtgtttatgat

SEQ ID NO: 3659 - DNA, 33 bp, homo sapien
aggtagatgaaacctasttctagttcgtgttct

SEQ ID NO: 3660 - DNA, 33 bp, homo sapien
ttaaaaatgagagatgytggttttaagtctgaa

SEQ ID NO: 3661 - DNA, 33 bp, homo sapien
tggcatcagttttcagsgatcaggaagactcaa

SEQ ID NO: 3662 - DNA, 33 bp, homo sapien
ttgtgaatcttagtaartaaaggtcaatttaag

SEQ ID NO: 3663 - DNA, 33 bp, homo sapien
agcattttctgggcaayttttgtgtgcctagga

SEQ ID NO: 3664 - DNA, 33 bp, homo sapien
gttgctgacacttactscatatggttgaatata

SEQ ID NO: 3665 - DNA, 33 bp, homo sapien
tttctacaccgttgtcrgaattaaatttctaaa

SEQ ID NO: 3666 - DNA, 33 bp, homo sapien
ctcctgtgcatagtcarcctgatgaccatcttg

SEQ ID NO: 3667 - DNA, 33 bp, homo sapien
taggagatttaattagwgcgaccaagaaaggaa

SEQ ID NO: 3668 - DNA, 33 bp, homo sapien
ggctttttaagatccakattttttctttatctt

SEQ ID NO: 3669 - DNA, 33 bp, homo sapien
aaatgtcttcctatacytaccactacttgaggc

SEQ ID NO: 3670 - DNA, 33 bp, homo sapien
accatgatcaagtctgyttagaaaggaaagagg

SEQ ID NO: 3671 - DNA, 33 bp, homo sapien
tctctctctccattgtytttactgggctgtgtc

SEQ ID NO: 3672 - DNA, 33 bp, homo sapien
tgctgtaagttgtctcrttatgatttctcacca

SEQ ID NO: 3673 - DNA, 33 bp, homo sapien
taatgcacttgttatakaataataaacgaatac

SEQ ID NO: 3674 - DNA, 33 bp, homo sapien
gatgcagacaaggaagytcagaggaggaacttt

SEQ ID NO: 3675 - DNA, 33 bp, homo sapien
aaccctaattttgcacsggagaaaatggggccc

SEQ ID NO: 3676 - DNA, 33 bp, homo sapien
cgaaaattcttagccaktattatttcaaatatt

SEQ ID NO: 3677 - DNA, 33 bp, homo sapien
gcgtcatatgaggtttrggtcctctttcaaact

SEQ ID NO: 3678 - DNA, 33 bp, homo sapien
ggtatgatcatagcatsgtgattttgttaaaac

SEQ ID NO: 3679 - DNA, 33 bp, homo sapien
cttttggtgacggcacmaatttccttgtcttgg

SEQ ID NO: 3680 - DNA, 33 bp, homo sapien
acaactggctactcttycaacgcaccatgacaa

SEQ ID NO: 3681 - DNA, 33 bp, homo sapien
ggatgggatactcagtmctttgaagaggctgag

SEQ ID NO: 3682 - DNA, 33 bp, homo sapien
tatcagtggtaataggmggtgcatctgagtcat

SEQ ID NO: 3683 - DNA, 33 bp, homo sapien
aataatgcacattcatmattgcaaaattcagac

SEQ ID NO: 3684 - DNA, 33 bp, homo sapien
gctcaactgatgctttstgtacgtgcttccttc

SEQ ID NO: 3685 - DNA, 33 bp, homo sapien
ctctgaaaaaataataygagccagaaggcaatg

SEQ ID NO: 3686 - DNA, 33 bp, homo sapien
aaggaaaatgtattcamagtgatggagtatatt

SEQ ID NO: 3687 - DNA, 33 bp, homo sapien
aagagttaggtattcaytgcagtctcctcagtc

SEQ ID NO: 3688 - DNA, 33 bp, homo sapien
taggacacagtctgaakgggaattatgttagag

SEQ ID NO: 3689 - DNA, 33 bp, homo sapien
tttgtggttcttcataragattgcataggactt

SEQ ID NO: 3690 - DNA, 33 bp, homo sapien
actacaaagggagacckcgtttagtttgagaac

SEQ ID NO: 3691 - DNA, 33 bp, homo sapien
gaagagcataggttttrttcatttccacatgag

SEQ ID NO: 3692 - DNA, 33 bp, homo sapien
gtaatccactgtttttrtactggagttctgttg

SEQ ID NO: 3693 - DNA, 33 bp, homo sapien
acatagcatattctagyctgttaggtgaacaaa

SEQ ID NO: 3694 - DNA, 33 bp, homo sapien
cctacgagctattcttygtacatatggtaaaat

SEQ ID NO: 3695 - DNA, 33 bp, homo sapien
tcagtgtcacatgaccrtcccagttttctccct

SEQ ID NO: 3696 - DNA, 33 bp, homo sapien
ccctgaactcagttgarccattcagataatcgt

SEQ ID NO: 3697 - DNA, 33 bp, homo sapien
gatgggctccagcgagkttctaaaccaagttca

SEQ ID NO: 3698 - DNA, 33 bp, homo sapien
acttatgcctcaattamagtaatagcatctcac

SEQ ID NO: 3699 - DNA, 33 bp, homo sapien
ctccctacttttaattkgcaacaagaaaaagga

SEQ ID NO: 3700 - DNA, 33 bp, homo sapien
aatactttttcctccamatgactccataagata

SEQ ID NO: 3701 - DNA, 33 bp, homo sapien
actaccagggcaataaygctcctgtttggccta

SEQ ID NO: 3702 - DNA, 33 bp, homo sapien
ttccccacaatgcaccragtggtcttcctaaaa

SEQ ID NO: 3703 - DNA, 33 bp, homo sapien
cagttttcttgcatacrttctctctgtattgct

SEQ ID NO: 3704 - DNA, 33 bp, homo sapien
gcaccttgaaagctacyaccaaatcactcaata

SEQ ID NO: 3705 - DNA, 33 bp, homo sapien
ggattcttttcatctgyctgctccttaaataaa

SEQ ID NO: 3706 - DNA, 33 bp, homo sapien
aagtcttctgttttcaygctcttatgtcctctc

SEQ ID NO: 3707 - DNA, 33 bp, homo sapien
agaaaaaaatggaccaygcagtgttggagcatt

SEQ ID NO: 3708 - DNA, 33 bp, homo sapien
ccttacagctcttggamaaaaggtctgttttac

SEQ ID NO: 3709 - DNA, 33 bp, homo sapien
ggactatactttggttyaaaagcggggttctaa

SEQ ID NO: 3710 - DNA, 33 bp, homo sapien
gctctagtttaaatctkaattcctgcaaccctc

SEQ ID NO: 3711 - DNA, 33 bp, homo sapien
cacttttgttctgaggrtagtggcctttgtagg

SEQ ID NO: 3712 - DNA, 33 bp, homo sapien
catctaacccacacagmgaactgagacatttca

SEQ ID NO: 3713 - DNA, 33 bp, homo sapien
ctcaggtagccgtttayagcccttgttgagctt

SEQ ID NO: 3714 - DNA, 33 bp, homo sapien
tttaagctcattcaaaytgttggctgaaaacag

SEQ ID NO: 3715 - DNA, 33 bp, homo sapien
gaacaccttgatgaggyagaaagagctacaggt

SEQ ID NO: 3716 - DNA, 33 bp, homo sapien
tcaccttttcataagaytcgcccaccaatgtcg

SEQ ID NO: 3717 - DNA, 33 bp, homo sapien
actgagatgatttattktatcactgctatctaa

SEQ ID NO: 3718 - DNA, 33 bp, homo sapien
tgcacttcatctccaakaataagtctcatttgt

SEQ ID NO: 3719 - DNA, 33 bp, homo sapien
tgccatgtactcactgwgattttgggcaggtca

SEQ ID NO: 3720 - DNA, 33 bp, homo sapien
gttgaatctcctcttcyttttcttataaggaca

SEQ ID NO: 3721 - DNA, 33 bp, homo sapien
tccctttaaaacagagrccttgtttatgtgtag

SEQ ID NO: 3722 - DNA, 33 bp, homo sapien
tgatccttgcattcagkcacagtgctctcctgc

SEQ ID NO: 3723 - DNA, 33 bp, homo sapien
tgacttttataactaayttactgacaattactt

SEQ ID NO: 3724 - DNA, 33 bp, homo sapien
tggaaggtgagtagacrcagagaaaatctctgg

SEQ ID NO: 3725 - DNA, 33 bp, homo sapien
ctaccctaacacatgtwttagattgaccaaaat

SEQ ID NO: 3726 - DNA, 33 bp, homo sapien
aaggatcctgacccaaraggtagactggacact

SEQ ID NO: 3727 - DNA, 33 bp, homo sapien
ccactttcaagtattarcaatcgagtctggcca

SEQ ID NO: 3728 - DNA, 33 bp, homo sapien
acattgtacacaggtaytgaaacatcacactgt

SEQ ID NO: 3729 - DNA, 33 bp, homo sapien
tattttgagcaagtaartaagtaaaggtcttct

SEQ ID NO: 3730 - DNA, 33 bp, homo sapien
tctgttattacttttcytgtacatctctgctta

SEQ ID NO: 3731 - DNA, 33 bp, homo sapien
aggggcggaagaagatrtggacacaaaagcaag

SEQ ID NO: 3732 - DNA, 33 bp, homo sapien
atggctccacctatcamggggacaatgatggca

SEQ ID NO: 3733 - DNA, 33 bp, homo sapien
atttataacatcaaacrctaggagaatcacaaa

SEQ ID NO: 3734 - DNA, 33 bp, homo sapien
ctttggtgaaatgttasaaaatatagaccactt

SEQ ID NO: 3735 - DNA, 33 bp, homo sapien
tggctagcaaatggccrggccaggattcaaacc

SEQ ID NO: 3736 - DNA, 33 bp, homo sapien
tgctgaaatagcaataygtatctgtacactggg

SEQ ID NO: 3737 - DNA, 33 bp, homo sapien
gttttactcaggttccygataatgtttgtcgca

SEQ ID NO: 3738 - DNA, 33 bp, homo sapien
gtgtatttatcttgctkagttctagtcgcagat

SEQ ID NO: 3739 - DNA, 33 bp, homo sapien
gagatcaaagttttgcytgagctataggaggaa

SEQ ID NO: 3740 - DNA, 33 bp, homo sapien
acatcacaattgaggamtggaggaactgcttac

SEQ ID NO: 3741 - DNA, 33 bp, homo sapien
aagatatagactggctraatggattttttaaaa

SEQ ID NO: 3742 - DNA, 33 bp, homo sapien
gtcttgttctctttccrtctgggtctaggttct

SEQ ID NO: 3743 - DNA, 33 bp, homo sapien
ttagtggagcagttgtyggtatggttatatatt

SEQ ID NO: 3744 - DNA, 33 bp, homo sapien
gtgtagggttgctttgmagtattcttttattgc

SEQ ID NO: 3745 - DNA, 33 bp, homo sapien
tgtgagttctctagccwcctctcatacctactg

SEQ ID NO: 3746 - DNA, 33 bp, homo sapien
aacagattttctggccrtgtgtctactgccata

SEQ ID NO: 3747 - DNA, 33 bp, homo sapien
tcagctcattctttgawtcattttattttgatt

SEQ ID NO: 3748 - DNA, 33 bp, homo sapien
tgcctcaacctacattkagaagtacgcctcaga

SEQ ID NO: 3749 - DNA, 33 bp, homo sapien
gagaatagatctaacaytggactgctttgaagg

SEQ ID NO: 3750 - DNA, 33 bp, homo sapien
cagtaggtcacaaggaktacacacattggctta

SEQ ID NO: 3751 - DNA, 33 bp, homo sapien
ctctgtgctagtttctyatactacttgtctaat

SEQ ID NO: 3752 - DNA, 33 bp, homo sapien
taatggtgtgttaaaaygctgcaatgaagaata

SEQ ID NO: 3753 - DNA, 33 bp, homo sapien
cagaatcagaactgttyaacttccaagcaaatg

SEQ ID NO: 3754 - DNA, 33 bp, homo sapien
tataaactggactataygaatgcattttgaaat

SEQ ID NO: 3755 - DNA, 33 bp, homo sapien
atttgtccaacagcacrtagttaatatgaagta

SEQ ID NO: 3756 - DNA, 33 bp, homo sapien
tttaaacaacacaaatktactgtatttcaggtc

SEQ ID NO: 3757 - DNA, 33 bp, homo sapien
cctagagccataatgcraaataagcctaaataa

SEQ ID NO: 3758 - DNA, 33 bp, homo sapien
gtttactaaaggcataractatctaaatgctct

SEQ ID NO: 3759 - DNA, 33 bp, homo sapien
aaaatgaccttcagctyccagttcctgagtttg

SEQ ID NO: 3760 - DNA, 33 bp, homo sapien
ttgtggatgaggaactwgaagattgggaagtcc

SEQ ID NO: 3761 - DNA, 33 bp, homo sapien
attcttaaaagttccaygtacactactatggtg

SEQ ID NO: 3762 - DNA, 33 bp, homo sapien
gtcagagagaaaaatcmttactatcttcacatg

SEQ ID NO: 3763 - DNA, 33 bp, homo sapien
taattaaaaattcacamggaaatgtaaaggaca

SEQ ID NO: 3764 - DNA, 33 bp, homo sapien
ttaatccatattgtttkgcatcaatatcacaaa

SEQ ID NO: 3765 - DNA, 33 bp, homo sapien
caatccaacacagtagktttcactatcaccatt

SEQ ID NO: 3766 - DNA, 33 bp, homo sapien
catcgatgaaaaaaatsataaactcattgtgag

SEQ ID NO: 3767 - DNA, 33 bp, homo sapien
acccatagtaatacatrggaaatcctggaggcc

SEQ ID NO: 3768 - DNA, 33 bp, homo sapien
tcaaggaacttacccayggatatacacctagtg

SEQ ID NO: 3769 - DNA, 33 bp, homo sapien
tggatatggcacatggytggggacctgaggcag

SEQ ID NO: 3770 - DNA, 33 bp, homo sapien
ttcccagctactctaaycattgatcctttactt

SEQ ID NO: 3771 - DNA, 33 bp, homo sapien
gttctccttatctaccytttaatatcttcctcc

SEQ ID NO: 3772 - DNA, 33 bp, homo sapien
cccaagatacttcattygaccattttaattaag

SEQ ID NO: 3773 - DNA, 33 bp, homo sapien
tcttatttttgccaacrtttaagggaggtagaa

SEQ ID NO: 3774 - DNA, 33 bp, homo sapien
taccttttaatctgcaytgaagtatttcaaatt

SEQ ID NO: 3775 - DNA, 33 bp, homo sapien
cagtgaggatacacttwcaacgaactgtaagca

SEQ ID NO: 3776 - DNA, 33 bp, homo sapien
gttcagtctcagctacrtactgtttcattctca

SEQ ID NO: 3777 - DNA, 33 bp, homo sapien
ggtgtacacacaggatrgacagttatatcttcc

SEQ ID NO: 3778 - DNA, 33 bp, homo sapien
cctgcaataccacttcratgcatactgtagaag

SEQ ID NO: 3779 - DNA, 33 bp, homo sapien
gaattctggggataatycagctaagcagatacc

SEQ ID NO: 3780 - DNA, 33 bp, homo sapien
ccattttgccttcattmttcagtggtttggcat

SEQ ID NO: 3781 - DNA, 33 bp, homo sapien
taatctctgtaagagakgctttcatgtagtact

SEQ ID NO: 3782 - DNA, 33 bp, homo sapien
ttccagcaaacacactstcttgacccgaggtga

SEQ ID NO: 3783 - DNA, 33 bp, homo sapien
tatatgcacccaaataygcagtttcctgtagat

SEQ ID NO: 3784 - DNA, 33 bp, homo sapien
agagacagtcttttagkttgtttgactgaagca

SEQ ID NO: 3785 - DNA, 33 bp, homo sapien
agtaggtagagcacagwtagaggagcctgagga

SEQ ID NO: 3786 - DNA, 33 bp, homo sapien
actcataaggttactawgaggattgagttaata

SEQ ID NO: 3787 - DNA, 33 bp, homo sapien
cactattcctgaattayttttaatactgcaaga

SEQ ID NO: 3788 - DNA, 33 bp, homo sapien
gtgaaaaataaatgatycctaaggagaacagat

SEQ ID NO: 3789 - DNA, 33 bp, homo sapien
ggccattttactgctaygtctctcaggtctctt

SEQ ID NO: 3790 - DNA, 33 bp, homo sapien
agacagggaaaatactrtaacacaatgataagg

SEQ ID NO: 3791 - DNA, 33 bp, homo sapien
cactcttttcattttgstaagtttgtttatttt

SEQ ID NO: 3792 - DNA, 33 bp, homo sapien
cactgtcaccattttamaaccataagagggctc

SEQ ID NO: 3793 - DNA, 33 bp, homo sapien
ttagcacaatggttagraggttaagttctgggt

SEQ ID NO: 3794 - DNA, 33 bp, homo sapien
caaacactgatgtaaaygtacaaaattcagggg

SEQ ID NO: 3795 - DNA, 33 bp, homo sapien
gtcagttgaaaaatgastcaacaatggcctact

SEQ ID NO: 3796 - DNA, 33 bp, homo sapien
atattgtcttcaaaacrtctgcattaagttatt

SEQ ID NO: 3797 - DNA, 33 bp, homo sapien
tggatccaagagtcagygagatggtgcccagtg

SEQ ID NO: 3798 - DNA, 33 bp, homo sapien
cttccagcatcagactyctatacctgcataatc

SEQ ID NO: 3799 - DNA, 33 bp, homo sapien
gggttctgactatatgrgtactaatagcagttt

SEQ ID NO: 3800 - DNA, 33 bp, homo sapien
atttatgttcaatataygtttgttgattaagag

SEQ ID NO: 3801 - DNA, 33 bp, homo sapien
aacagttcattctccaktttacatctccatatc

SEQ ID NO: 3802 - DNA, 33 bp, homo sapien
cctgcttgggttttgaytgggattatgactata

SEQ ID NO: 3803 - DNA, 33 bp, homo sapien
ccaaggcaatatgacaygaacaaaggaatgtaa

SEQ ID NO: 3804 - DNA, 33 bp, homo sapien
ttaaaaagcagcagcaytgcaaacatagtagct

SEQ ID NO: 3805 - DNA, 33 bp, homo sapien
ccagcaattctgttccyagagaaatgaaaacgt

SEQ ID NO: 3806 - DNA, 33 bp, homo sapien
gtagaaccatgaagacrtcattgcagcatgata

SEQ ID NO: 3807 - DNA, 33 bp, homo sapien
ggaccctggtccctgcrttctagccactccagc

SEQ ID NO: 3808 - DNA, 33 bp, homo sapien
ccaaggataatctgagrttcacgcaaagacaaa

SEQ ID NO: 3809 - DNA, 33 bp, homo sapien
atgcacaagtaggaccyagagacagagtttact

SEQ ID NO: 3810 - DNA, 33 bp, homo sapien
cttcactgtcacctgartgagactatgagcaca

SEQ ID NO: 3811 - DNA, 33 bp, homo sapien
ctgcttcatagtctcamatgttcatgagatttg

SEQ ID NO: 3812 - DNA, 33 bp, homo sapien
tcccatttacttgtggycgatgagttgtgctaa

SEQ ID NO: 3813 - DNA, 33 bp, homo sapien
atgcattgtatctgccrctgattgctgttaaaa

SEQ ID NO: 3814 - DNA, 33 bp, homo sapien
ccttggacaatgatttstaagcacctgtatctt

SEQ ID NO: 3815 - DNA, 33 bp, homo sapien
agagagggaaatgaccrtagaaattagccttgg

SEQ ID NO: 3816 - DNA, 33 bp, homo sapien
aaagttagcttatgtcyttggaaatggaaatgg

SEQ ID NO: 3817 - DNA, 33 bp, homo sapien
aataaacttgtactaaygttatgacatgtctta

SEQ ID NO: 3818 - DNA, 33 bp, homo sapien
tagtctggtctaaactkcaagtgacttataatg

SEQ ID NO: 3819 - DNA, 33 bp, homo sapien
tttcggtgaattccacrgtggccatgctgcact

SEQ ID NO: 3820 - DNA, 33 bp, homo sapien
ccttagttaactttttycttgcatactattcca

SEQ ID NO: 3821 - DNA, 33 bp, homo sapien
aatgagattcttaacckttctaatgcgctgacc

SEQ ID NO: 3822 - DNA, 33 bp, homo sapien
aggggaaagcttaaacrttagctactctacctc

SEQ ID NO: 3823 - DNA, 33 bp, homo sapien
attgaatgagttcaagkaaggccaagagagatc

SEQ ID NO: 3824 - DNA, 33 bp, homo sapien
ataactttggaaagaaytgagccagcccagtga

SEQ ID NO: 3825 - DNA, 33 bp, homo sapien
tgctttgggaagaaaaygtctgtattgaaagga

SEQ ID NO: 3826 - DNA, 33 bp, homo sapien
ttcccagcaacaatcaragaaagttcttgttgc

SEQ ID NO: 3827 - DNA, 33 bp, homo sapien
tcccatctctaagttcyaaataagtgaattttg

SEQ ID NO: 3828 - DNA, 33 bp, homo sapien
ttgacagtgtactgaaygatgcaggctatcttc

SEQ ID NO: 3829 - DNA, 33 bp, homo sapien
ttagatctcaacatacraatattaaaggaaccc

SEQ ID NO: 3830 - DNA, 33 bp, homo sapien
tgtttaagctagttctytccagtacagggattg

SEQ ID NO: 3831 - DNA, 33 bp, homo sapien
atttaaaatagcagtcmaaaaaatcaagacaga

SEQ ID NO: 3832 - DNA, 33 bp, homo sapien
aatcataaaacactccraatacccagaacaatc

SEQ ID NO: 3833 - DNA, 33 bp, homo sapien
caagctaccgacgtgcrtcaaccagccttaaaa

SEQ ID NO: 3834 - DNA, 33 bp, homo sapien
agtgtggcactatcatytactacccattctaga

SEQ ID NO: 3835 - DNA, 33 bp, homo sapien
aatcactgttcaatgtycatattcctacccaca

SEQ ID NO: 3836 - DNA, 33 bp, homo sapien
tattctagcataactgrcctttattgcaaattg

SEQ ID NO: 3837 - DNA, 33 bp, homo sapien
gtgccaaagtatgaagrtagaaagcagcagtaa

SEQ ID NO: 3838 - DNA, 33 bp, homo sapien
acctgagtgaaggttgrtatcattttctgagat

SEQ ID NO: 3839 - DNA, 33 bp, homo sapien
ccacaggccaataacargcatggagctagggct

SEQ ID NO: 3840 - DNA, 33 bp, homo sapien
agctccttcctgtacayaccagcttgagcagtt

SEQ ID NO: 3841 - DNA, 33 bp, homo sapien
cggccatgacctgaacmaagatcagtagacagc

SEQ ID NO: 3842 - DNA, 33 bp, homo sapien
acaattcttccaagctmtttgcaactgtaaaca

SEQ ID NO: 3843 - DNA, 33 bp, homo sapien
catgaggcattgctttygcttcattacacttgt

SEQ ID NO: 3844 - DNA, 33 bp, homo sapien
agccctaaatacagcaragtggttcccaggctt

SEQ ID NO: 3845 - DNA, 33 bp, homo sapien
agcaagtagatactcayatattgaatagatcac

SEQ ID NO: 3846 - DNA, 33 bp, homo sapien
gaaaaacatctggatartttagaacttctcagg

SEQ ID NO: 3847 - DNA, 33 bp, homo sapien
gtacataaatgcagccmgagagaatagccagag

SEQ ID NO: 3848 - DNA, 33 bp, homo sapien
gaaaatcaaaacgagtrgaaatgaaactataat

SEQ ID NO: 3849 - DNA, 33 bp, homo sapien
tcctctctcaagtcaaygtttgattggtgtgtg

SEQ ID NO: 3850 - DNA, 33 bp, homo sapien
aatatgcaccttctctktcccatctctttttgt

SEQ ID NO: 3851 - DNA, 33 bp, homo sapien
aatatttggaaattaartgtctgagaacaccaa

SEQ ID NO: 3852 - DNA, 33 bp, homo sapien
aatttgtgcagaaaatygtaagtagctgaattt

SEQ ID NO: 3853 - DNA, 33 bp, homo sapien
agttttaatcccgactstactcttttcctcttc

SEQ ID NO: 3854 - DNA, 33 bp, homo sapien
gcctctttactttcatytatgtcatggtcagtc

SEQ ID NO: 3855 - DNA, 33 bp, homo sapien
tttattcattaaggatktctaacaccaaactac

SEQ ID NO: 3856 - DNA, 33 bp, homo sapien
caacttgttaactctcytgtgttcatctgtgct

SEQ ID NO: 3857 - DNA, 33 bp, homo sapien
tgactaatagccgtatraaggagttgggcataa

SEQ ID NO: 3858 - DNA, 33 bp, homo sapien
gtcttctctgtacttayatgaatttgattaagt

SEQ ID NO: 3859 - DNA, 33 bp, homo sapien
gactataatctgtgaaragtgtgttcagctata

SEQ ID NO: 3860 - DNA, 33 bp, homo sapien
cacttcctgggtgagtmgatgccctgccctgct

SEQ ID NO: 3861 - DNA, 33 bp, homo sapien
agaaaactacaagtcartcttcctgatgaacac

SEQ ID NO: 3862 - DNA, 33 bp, homo sapien
ggcatgtggcttctccrggctcaaaaaaacacc

SEQ ID NO: 3863 - DNA, 33 bp, homo sapien
gtcttaagtgagatgaygtaaatagtttattac

SEQ ID NO: 3864 - DNA, 33 bp, homo sapien
ctaaacagtggtaaaaygagattatgtacaggt

SEQ ID NO: 3865 - DNA, 33 bp, homo sapien
actcagttacaccctaygcacatgaagacctag

SEQ ID NO: 3866 - DNA, 33 bp, homo sapien
tgctgtttgcagcaacrtggataaacctagaaa

SEQ ID NO: 3867 - DNA, 33 bp, homo sapien
gttcattgtgccattgwctatgttggttaataa

SEQ ID NO: 3868 - DNA, 33 bp, homo sapien
attgttttttgactacygtccagagtttctagc

SEQ ID NO: 3869 - DNA, 33 bp, homo sapien
attttcactctaccaamaaaaggcaaaatgtct

SEQ ID NO: 3870 - DNA, 33 bp, homo sapien
tgagtttccgacattcygtattagacatatgtt

SEQ ID NO: 3871 - DNA, 33 bp, homo sapien
ctagactcactgttttyctgaagtgggaagagg

SEQ ID NO: 3872 - DNA, 33 bp, homo sapien
tgtatgtatcttgtaarttgagacagctctatt

SEQ ID NO: 3873 - DNA, 33 bp, homo sapien
aaatcacggaaatatgwttgcatcagacaatgg

SEQ ID NO: 3874 - DNA, 33 bp, homo sapien
gtagtgggaaatggagwagtgttaatcttatgc

SEQ ID NO: 3875 - DNA, 33 bp, homo sapien
tagctaaacacactcartgagaaaaggacattt

SEQ ID NO: 3876 - DNA, 33 bp, homo sapien
ggctctaatcccattcwtaagggcagagtctcc

SEQ ID NO: 3877 - DNA, 33 bp, homo sapien
agcattcagtattttgrcaagaatttagtgaga

SEQ ID NO: 3878 - DNA, 33 bp, homo sapien
tttaaaaaagagattgrcagtctaagcattcgt

SEQ ID NO: 3879 - DNA, 33 bp, homo sapien
ggtttcatgagctacaraaggttgcaaaacatg

SEQ ID NO: 3880 - DNA, 33 bp, homo sapien
ttttctaagcatgaaamtgatttagtagcaagg

SEQ ID NO: 3881 - DNA, 33 bp, homo sapien
aaggattttgagtaagrgatttttctggattat

SEQ ID NO: 3882 - DNA, 33 bp, homo sapien
aaagcttttaaaacaakccatgtgttagtctca

SEQ ID NO: 3883 - DNA, 33 bp, homo sapien
gctcattgctccttacrtgtcagaagcacctct

SEQ ID NO: 3884 - DNA, 33 bp, homo sapien
tagagtacagtgcttayaggcagtttcttttgc

SEQ ID NO: 3885 - DNA, 33 bp, homo sapien
tttgtgaactgaccttyccattcctgagttcct

SEQ ID NO: 3886 - DNA, 33 bp, homo sapien
ggtgatgaactcctgaktgattgcctcagctaa

SEQ ID NO: 3887 - DNA, 33 bp, homo sapien
cttagaccagatttcayggcaatcccttgaaac

SEQ ID NO: 3888 - DNA, 33 bp, homo sapien
gatcccagcaaaatgaytttcaaaagaggatag

SEQ ID NO: 3889 - DNA, 33 bp, homo sapien
accttgctcacagattktggagtccaattgcca

SEQ ID NO: 3890 - DNA, 33 bp, homo sapien
tcagtggagccctgtcrtccttaaagatctctg

SEQ ID NO: 3891 - DNA, 33 bp, homo sapien
ttcagatgctgaagtcrgagtctacataaatag

SEQ ID NO: 3892 - DNA, 33 bp, homo sapien
agggtatatggtggtawgagagctgacataaca

SEQ ID NO: 3893 - DNA, 33 bp, homo sapien
tacaagacttacgcctkggataccttttattct

SEQ ID NO: 3894 - DNA, 33 bp, homo sapien
gaatgagttcatgtccygagccaataataacta

SEQ ID NO: 3895 - DNA, 33 bp, homo sapien
cagacaagacaaaaagygttactagaaatcaag

SEQ ID NO: 3896 - DNA, 33 bp, homo sapien
actaattcaagtttccrtttgtattctggtaga

SEQ ID NO: 3897 - DNA, 33 bp, homo sapien
agcttccttgacgtcaytggctacaggctacag

SEQ ID NO: 3898 - DNA, 33 bp, homo sapien
gaccatagagatgacasaattattttagagaag

SEQ ID NO: 3899 - DNA, 33 bp, homo sapien
attatgcttagttttawctccacagaattgttg

SEQ ID NO: 3900 - DNA, 33 bp, homo sapien
ctaaacactattctctwatgaaaaggatcaagg

SEQ ID NO: 3901 - DNA, 33 bp, homo sapien
actgtgtgcgttaacaygtaatttagtacatat

SEQ ID NO: 3902 - DNA, 33 bp, homo sapien
tctatataggctatatkgagagtttatttgaac

SEQ ID NO: 3903 - DNA, 33 bp, homo sapien
ttagtgctggttctgcytgaaatgtgagcacat

SEQ ID NO: 3904 - DNA, 33 bp, homo sapien
ctctaaagtatctccaygaggttggtcattggc

SEQ ID NO: 3905 - DNA, 33 bp, homo sapien
agtaaactcagatctayctcacatttaaaactg

SEQ ID NO: 3906 - DNA, 33 bp, homo sapien
aaaaaaaaaagcatgaytgtgacacctggaaaa

SEQ ID NO: 3907 - DNA, 33 bp, homo sapien
gtcacaggaagaaaacyagacttagagaaggac

SEQ ID NO: 3908 - DNA, 33 bp, homo sapien
ctttcgttgaaacacartagcattacaagggta

SEQ ID NO: 3909 - DNA, 33 bp, homo sapien
attcctatcatcattgrcccacattgtggtttg

SEQ ID NO: 3910 - DNA, 33 bp, homo sapien
gctctctgtggtggaaytgaaccatctttgtaa

SEQ ID NO: 3911 - DNA, 33 bp, homo sapien
agtggcttctttactgkgcttcgcagcatacac

SEQ ID NO: 3912 - DNA, 33 bp, homo sapien
ttgttgtgccaactcckcaagaattgaaacacc

SEQ ID NO: 3913 - DNA, 33 bp, homo sapien
ctattggtaaaaaaaawgaatgtctcataggta

SEQ ID NO: 3914 - DNA, 33 bp, homo sapien
taagtgagaacatgtgktatttagcgtgtagta

SEQ ID NO: 3915 - DNA, 33 bp, homo sapien
cctgcctggaccttcgytatccttctctaacta

SEQ ID NO: 3916 - DNA, 33 bp, homo sapien
ccttattaaaatgtgayacaagtgaaggaagat

SEQ ID NO: 3917 - DNA, 33 bp, homo sapien
taaagaaaagataccaygctgcaaagtctcttg

SEQ ID NO: 3918 - DNA, 33 bp, homo sapien
agagactgattcagtaygaacactggaaatact

SEQ ID NO: 3919 - DNA, 33 bp, homo sapien
ttaatctaagaagaaayatgtttgaggccacaa

SEQ ID NO: 3920 - DNA, 33 bp, homo sapien
aagtctctgaacatacygtacttgtccaaatga

SEQ ID NO: 3921 - DNA, 33 bp, homo sapien
taacgctaaataaagckatcctggtgtgtttac

SEQ ID NO: 3922 - DNA, 33 bp, homo sapien
ggcccttgttccaataraacgttactaaaacaa

SEQ ID NO: 3923 - DNA, 33 bp, homo sapien
gtgaaggcttaaaatarccagtccctattgctt

SEQ ID NO: 3924 - DNA, 33 bp, homo sapien
tagagagtttgttcaayggaataataatacaga

SEQ ID NO: 3925 - DNA, 33 bp, homo sapien
ggatagggcctggtatmcctattttgaaagatc

SEQ ID NO: 3926 - DNA, 33 bp, homo sapien
tcttgcccataggccasttaacagctttgtgct

SEQ ID NO: 3927 - DNA, 33 bp, homo sapien
cccccaacactgtgccyatttcatattatagca

SEQ ID NO: 3928 - DNA, 33 bp, homo sapien
tactttagctgggctgrtctgaatacaattgtt

SEQ ID NO: 3929 - DNA, 33 bp, homo sapien
cttgtgttcaaagcagygctattcatattacca

SEQ ID NO: 3930 - DNA, 33 bp, homo sapien
tttacttgtatttgctyggtgaagtgaaatgtt

SEQ ID NO: 3931 - DNA, 33 bp, homo sapien
tcttctaatgaatgtaygggttagcagggctca

SEQ ID NO: 3932 - DNA, 33 bp, homo sapien
tactaggattatgctgrgtcagaccgatgccag

SEQ ID NO: 3933 - DNA, 33 bp, homo sapien
ctcctaaatctccgcaytgaataggactcaagg

SEQ ID NO: 3934 - DNA, 33 bp, homo sapien
ttaatacttgacatttkaagaaactaggctggc

SEQ ID NO: 3935 - DNA, 33 bp, homo sapien
ataccctggattgctastaaaaatgcagaataa

SEQ ID NO: 3936 - DNA, 33 bp, homo sapien
taaaatggggatgacartgcttcctgtctcagc

SEQ ID NO: 3937 - DNA, 33 bp, homo sapien
atatgtgaaagtctttygattgtttccattttc

SEQ ID NO: 3938 - DNA, 33 bp, homo sapien
agcaagtatatggtagyaccaggttttgaacgt

SEQ ID NO: 3939 - DNA, 33 bp, homo sapien
cctgagtttttggcccraggatggaggatggga

SEQ ID NO: 3940 - DNA, 33 bp, homo sapien
ctttgagaatatgtgayggatcatcttcttaca

SEQ ID NO: 3941 - DNA, 33 bp, homo sapien
atttttcagttcatcawttgaattttacagctc

SEQ ID NO: 3942 - DNA, 33 bp, homo sapien
aatgatcaaatattccrtgagtgttccaattaa

SEQ ID NO: 3943 - DNA, 33 bp, homo sapien
tactcctcaaatctatktgtatagtcgacacaa

SEQ ID NO: 3944 - DNA, 33 bp, homo sapien
cctttctgaacgcttgyatgattgcttctttgc

SEQ ID NO: 3945 - DNA, 33 bp, homo sapien
gttaatttgctttcctktaccagacacctctga

SEQ ID NO: 3946 - DNA, 33 bp, homo sapien
taccttccaatttcaasatttaggactctatga

SEQ ID NO: 3947 - DNA, 33 bp, homo sapien
gctgactcttagaaccrtaataatgcttcgcca

SEQ ID NO: 3948 - DNA, 33 bp, homo sapien
cctcctccctccagtckgtaaaatgtcttagca

SEQ ID NO: 3949 - DNA, 33 bp, homo sapien
gtacaaacattcccaamgctgagcagccacccc

SEQ ID NO: 3950 - DNA, 33 bp, homo sapien
aaagtcacaagttgaarttgaataaccactgta

SEQ ID NO: 3951 - DNA, 33 bp, homo sapien
ttctgcttatatcccawtggccagaaatgtgtt

SEQ ID NO: 3952 - DNA, 33 bp, homo sapien
cttcatcacgagtagaktttgtttcaagaaacc

SEQ ID NO: 3953 - DNA, 33 bp, homo sapien
agccaggtttgcagagrctgcctttccatgtca

SEQ ID NO: 3954 - DNA, 33 bp, homo sapien
tccttcaaaacacttgygtcaggacaagaatca

SEQ ID NO: 3955 - DNA, 33 bp, homo sapien
agatgccagataaaagrcatgaattattttggt

SEQ ID NO: 3956 - DNA, 33 bp, homo sapien
ggttcactgcatactaytgatctttaaaaattg

SEQ ID NO: 3957 - DNA, 33 bp, homo sapien
tttacctgtctggcagyatatggtgtggctgtg

SEQ ID NO: 3958 - DNA, 33 bp, homo sapien
catggttaccaagctamagtttttgttcattat

SEQ ID NO: 3959 - DNA, 33 bp, homo sapien
ttccactgctcaatccrtacagtgagtaaaatt

SEQ ID NO: 3960 - DNA, 33 bp, homo sapien
gaggcagggcagttctrtagtcttcaccacagt

SEQ ID NO: 3961 - DNA, 33 bp, homo sapien
ttcaactaatatcacaragagatgttcttaatc

SEQ ID NO: 3962 - DNA, 33 bp, homo sapien
tggagttgtaggtcacygggtgcagaaccagtc

SEQ ID NO: 3963 - DNA, 33 bp, homo sapien
gtttcttttcaggcagygaaaaagttctaaaat

SEQ ID NO: 3964 - DNA, 33 bp, homo sapien
tttctcttctgtttcastggacatacaatactg

SEQ ID NO: 3965 - DNA, 33 bp, homo sapien
cttctaattcaatcagrtatccttagaaccaat

SEQ ID NO: 3966 - DNA, 33 bp, homo sapien
atactagtaatcactcwctctgctatttatttt

SEQ ID NO: 3967 - DNA, 33 bp, homo sapien
gggaaatatctcacagyatgattttattacagg

SEQ ID NO: 3968 - DNA, 33 bp, homo sapien
gggggtagaggtttgcytatgtgattaaatgaa

SEQ ID NO: 3969 - DNA, 33 bp, homo sapien
aaagaaacaattgtcgrtggtggaaataacagc

SEQ ID NO: 3970 - DNA, 33 bp, homo sapien
ccactctgcactgaatmctatctgcgaaatccc

SEQ ID NO: 3971 - DNA, 33 bp, homo sapien
ctcagaagggccactcyaaactcttgaaactgt

SEQ ID NO: 3972 - DNA, 33 bp, homo sapien
actattttaagctcacygttgagagacctactg

SEQ ID NO: 3973 - DNA, 33 bp, homo sapien
catttgtgtcttgctgscttcagtcttgctcat

SEQ ID NO: 3974 - DNA, 33 bp, homo sapien
ttggaggaatgtaagargaatctgctgggaaaa

SEQ ID NO: 3975 - DNA, 33 bp, homo sapien
cttaagtgtaccagctrgaagtaactacaagta

SEQ ID NO: 3976 - DNA, 33 bp, homo sapien
tgtgcccctcaagacaygcaatctctgcaaacc

SEQ ID NO: 3977 - DNA, 33 bp, homo sapien
ggaaaaaaaatgatgaygggcacagtctcagag

SEQ ID NO: 3978 - DNA, 33 bp, homo sapien
cgtgagaccagacccgmtaaggatgctcaatcc

SEQ ID NO: 3979 - DNA, 33 bp, homo sapien
atatttcattgttgctyttgatggttttaatgc

SEQ ID NO: 3980 - DNA, 33 bp, homo sapien
agaagtggactttttascttaatgtatgaaata

SEQ ID NO: 3981 - DNA, 33 bp, homo sapien
atttatcatttgaaacyagaaaactgttgccat

SEQ ID NO: 3982 - DNA, 33 bp, homo sapien
ctaacagtgttggcaamggcacggggaaataag

SEQ ID NO: 3983 - DNA, 33 bp, homo sapien
catgtatatcttccacrtgatagttatggctta

SEQ ID NO: 3984 - DNA, 33 bp, homo sapien
accagtcttagtatttmtctggttccctcatta

SEQ ID NO: 3985 - DNA, 33 bp, homo sapien
tcctgtaaggcagagcwgtgagtgaatgtcttt

SEQ ID NO: 3986 - DNA, 33 bp, homo sapien
accacttggctttttargtgatagcttgctaga

SEQ ID NO: 3987 - DNA, 33 bp, homo sapien
atagcagttttatagcygtattacttcaaattg

SEQ ID NO: 3988 - DNA, 33 bp, homo sapien
tcaggtaacagtgtctygttttcccttttacat

SEQ ID NO: 3989 - DNA, 33 bp, homo sapien
agtataataaatatgtsatggagaagtaatatt

SEQ ID NO: 3990 - DNA, 33 bp, homo sapien
cgttttctaaacaaccyttccatgtccacttcc

SEQ ID NO: 3991 - DNA, 33 bp, homo sapien
gggatggcacaaggttygagaggccaaagagac

SEQ ID NO: 3992 - DNA, 33 bp, homo sapien
agacacatttcaacaasggctaaaaacatataa

SEQ ID NO: 3993 - DNA, 33 bp, homo sapien
tgagaattttgacagtycatatgtggtgaaaaa

SEQ ID NO: 3994 - DNA, 33 bp, homo sapien
ttttagttgcaatgackgtgtaattttcagagg

SEQ ID NO: 3995 - DNA, 33 bp, homo sapien
gaagatctttacaagasctgagccatagaatat

SEQ ID NO: 3996 - DNA, 33 bp, homo sapien
caaaggtagctttgccractaagacccagcaga

SEQ ID NO: 3997 - DNA, 33 bp, homo sapien
ggagattaaacaagcaygtacaaaggagaaggt

SEQ ID NO: 3998 - DNA, 33 bp, homo sapien
gaagaaagactgtcacrgcagaaagtgtcatca

SEQ ID NO: 3999 - DNA, 33 bp, homo sapien
tttagaattattgcaaytatcttttaacaagct

SEQ ID NO: 4000 - DNA, 33 bp, homo sapien
actttctcttcttgctrttgtcagacaacacta

SEQ ID NO: 4001 - DNA, 33 bp, homo sapien
tcaagtaggctttaaamagattcaaccaaagcc

SEQ ID NO: 4002 - DNA, 33 bp, homo sapien
tgtaagatttaatatgytgttactgtaagctta

SEQ ID NO: 4003 - DNA, 33 bp, homo sapien
tacatacaatagagacyatcaacaaaggaaaaa

SEQ ID NO: 4004 - DNA, 33 bp, homo sapien
gagatatagtggccatrgtaagaagaaggaaac

SEQ ID NO: 4005 - DNA, 33 bp, homo sapien
aatattgggagaatatraagccaatgtactttc

SEQ ID NO: 4006 - DNA, 33 bp, homo sapien
tctttttcttggtgttkgtgctggtagcactgg

SEQ ID NO: 4007 - DNA, 33 bp, homo sapien
tacgcttcgatttgatsagactttgaatgtgtg

SEQ ID NO: 4008 - DNA, 33 bp, homo sapien
gcgttttggaccatcartgctttcctaattata

SEQ ID NO: 4009 - DNA, 33 bp, homo sapien
ccttagttggctcagcrtgccttaacagaatac

SEQ ID NO: 4010 - DNA, 33 bp, homo sapien
aaaacttattcaaatcwgtgagttcaaaaaaat

SEQ ID NO: 4011 - DNA, 33 bp, homo sapien
gaggcatgctaattgtrtgggatcacttaccct

SEQ ID NO: 4012 - DNA, 33 bp, homo sapien
aactactatttattacmtaccaactcaagagtg

SEQ ID NO: 4013 - DNA, 33 bp, homo sapien
aggttcgctgttattartgtactccgtggcgtg

SEQ ID NO: 4014 - DNA, 33 bp, homo sapien
tttattgtttatttgtrggcattattgtagaag

SEQ ID NO: 4015 - DNA, 33 bp, homo sapien
ctatctacggtaggtcrttaagcagccaatgat

SEQ ID NO: 4016 - DNA, 33 bp, homo sapien
attacatgttaattacrcttctataaaactgtt

SEQ ID NO: 4017 - DNA, 33 bp, homo sapien
ttaagccactcagtctkctgtcttgttatagca

SEQ ID NO: 4018 - DNA, 33 bp, homo sapien
ctatatcctttactatyctcttagtcttctttg

SEQ ID NO: 4019 - DNA, 33 bp, homo sapien
gaaacataacaccttgwcaccaggatgtggctg

SEQ ID NO: 4020 - DNA, 33 bp, homo sapien
agttcattatttgcctygactgtctctaatttt

SEQ ID NO: 4021 - DNA, 33 bp, homo sapien
aatcaatgatcctagcytaatgtgctatttttt

SEQ ID NO: 4022 - DNA, 33 bp, homo sapien
tgggttaaatgtcaggyccattatttattggct

SEQ ID NO: 4023 - DNA, 33 bp, homo sapien
tactataataataatgygtatgaagcgatttct

SEQ ID NO: 4024 - DNA, 33 bp, homo sapien
tgagattttttgatgcrtttgggtaagtaaatc

SEQ ID NO: 4025 - DNA, 33 bp, homo sapien
ttccaatttgattggcyacggtaaggttcaggc

SEQ ID NO: 4026 - DNA, 33 bp, homo sapien
atagccaggattcatasgtctaggaatcaaggg

SEQ ID NO: 4027 - DNA, 33 bp, homo sapien
gggagatgaatagccaygttttcagaaaagaat

SEQ ID NO: 4028 - DNA, 33 bp, homo sapien
gaacgcctttaggttcrggaagtagatgagaaa

SEQ ID NO: 4029 - DNA, 33 bp, homo sapien
ataccagacttgaaatyagcactattaggacaa

SEQ ID NO: 4030 - DNA, 33 bp, homo sapien
gttacctcctcaatgtrggacttcatatttcag

SEQ ID NO: 4031 - DNA, 33 bp, homo sapien
attacttcttttagttkctgagcttaatcatta

SEQ ID NO: 4032 - DNA, 33 bp, homo sapien
tatatctatcagggtcrttagaaaattggccta

SEQ ID NO: 4033 - DNA, 33 bp, homo sapien
gtttttgagtgactttygttttcttctttgtgc

SEQ ID NO: 4034 - DNA, 33 bp, homo sapien
aatttaatgaacaggtwaaaaaaaatgcgaaat

SEQ ID NO: 4035 - DNA, 33 bp, homo sapien
ttgattgtattgttttktctataactttgtgtt

SEQ ID NO: 4036 - DNA, 33 bp, homo sapien
cagtctcactcctaccrctacaagagacacctg

SEQ ID NO: 4037 - DNA, 33 bp, homo sapien
cctaccttggctcttgrcactagagttccagag

SEQ ID NO: 4038 - DNA, 33 bp, homo sapien
cagcacttacaaactgyatctcaatttcccctg

SEQ ID NO: 4039 - DNA, 33 bp, homo sapien
ggtcacagaagcagagsatggtatccccagaga

SEQ ID NO: 4040 - DNA, 33 bp, homo sapien
agtgcatttgcaaatcsttggttcacaataagt

SEQ ID NO: 4041 - DNA, 33 bp, homo sapien
tgtatggattgcaccakcgggcttcttagcctt

SEQ ID NO: 4042 - DNA, 33 bp, homo sapien
ggatttagaaagacagsatcactaaaagacaca

SEQ ID NO: 4043 - DNA, 33 bp, homo sapien
tgaaaatgtcatcccastgtcatcttgacagca

SEQ ID NO: 4044 - DNA, 33 bp, homo sapien
cacagtctcagcttgcygcaatcttggtctccc

SEQ ID NO: 4045 - DNA, 33 bp, homo sapien
ccgcaatgctgtaaatmggagtcattaatcttt

SEQ ID NO: 4046 - DNA, 33 bp, homo sapien
atacattagccttccaytgagatactgactttg

SEQ ID NO: 4047 - DNA, 33 bp, homo sapien
atagaacaccctgcaaytgagcaaactacgtcc

SEQ ID NO: 4048 - DNA, 33 bp, homo sapien
ctcttgtgcccttctgygttttgctttgtgagg

SEQ ID NO: 4049 - DNA, 33 bp, homo sapien
tggtgtttaatcctggkttagcaaaaatggggg

SEQ ID NO: 4050 - DNA, 33 bp, homo sapien
tcaatctgtgcttctcmtaactactgggttata

SEQ ID NO: 4051 - DNA, 33 bp, homo sapien
tgaagagaatgtggtcrcaatcaataggaaaca

SEQ ID NO: 4052 - DNA, 33 bp, homo sapien
cctgcttataagagcayagtatttcgtagccca

SEQ ID NO: 4053 - DNA, 33 bp, homo sapien
aagcagagaatagaatrgtggttatcagaggtt

SEQ ID NO: 4054 - DNA, 33 bp, homo sapien
ttgctggttatttttartagagctcaacattat

SEQ ID NO: 4055 - DNA, 33 bp, homo sapien
gggaaatgtcagtaccwgtttatgacaaaatct

SEQ ID NO: 4056 - DNA, 33 bp, homo sapien
ttatatacgtaacaaartatgttcaagatctgt

SEQ ID NO: 4057 - DNA, 33 bp, homo sapien
gtgtcaacactgtactrtgcgtctgcctcttta

SEQ ID NO: 4058 - DNA, 33 bp, homo sapien
ggcttctgccttactcyttctctttttggaata

SEQ ID NO: 4059 - DNA, 33 bp, homo sapien
acagacaaatcagtgcyacagttgcaccaatct

SEQ ID NO: 4060 - DNA, 33 bp, homo sapien
gcctgggtgatagagcrgaaccctttttcaaaa

SEQ ID NO: 4061 - DNA, 33 bp, homo sapien
aagtttctttgtcacaygaagagagctgtgaag

SEQ ID NO: 4062 - DNA, 33 bp, homo sapien
acaaattcaattgtttmaagagcaaaaatttat

SEQ ID NO: 4063 - DNA, 33 bp, homo sapien
tgcttctgagccataayatcctttctcataatg

SEQ ID NO: 4064 - DNA, 33 bp, homo sapien
tttcttcccaggattcrtttccatcttttctca

SEQ ID NO: 4065 - DNA, 33 bp, homo sapien
cccatatttctgccacractaagaggaagctgg

SEQ ID NO: 4066 - DNA, 33 bp, homo sapien
tgaaacatactcaaatrtaagtagacataagta

SEQ ID NO: 4067 - DNA, 33 bp, homo sapien
ccaacagacaactgtaygctaacagaaaattat

SEQ ID NO: 4068 - DNA, 33 bp, homo sapien
atttctctgctttgaarttatttatccctcttt

SEQ ID NO: 4069 - DNA, 33 bp, homo sapien
ttaaacaactggtttakgaaaagctactggact

SEQ ID NO: 4070 - DNA, 33 bp, homo sapien
gtagatccaaagttttygtgcaaaatgtaacgg

SEQ ID NO: 4071 - DNA, 33 bp, homo sapien
gacaacaattgggaaayactcttgccagcaaaa

SEQ ID NO: 4072 - DNA, 33 bp, homo sapien
agatatgtaagtttgasgtgaagtgggcttgga

SEQ ID NO: 4073 - DNA, 33 bp, homo sapien
atatgaacaatctaaamtagtcatgttcttaga

SEQ ID NO: 4074 - DNA, 33 bp, homo sapien
cattacttgtttttacrctaattcacaaatatt

SEQ ID NO: 4075 - DNA, 33 bp, homo sapien
ttttatagtgttagctyctataggatttaggtc

SEQ ID NO: 4076 - DNA, 33 bp, homo sapien
atacctgtatctcttcrcagtcatgatgtctca

SEQ ID NO: 4077 - DNA, 33 bp, homo sapien
tcacagaattagtccasacaggtagccaacaaa

SEQ ID NO: 4078 - DNA, 33 bp, homo sapien
ccaataaatatttatcratgtgcaaaacagctt

SEQ ID NO: 4079 - DNA, 33 bp, homo sapien
taattgttttaactacrtgggattttgggaaga

SEQ ID NO: 4080 - DNA, 33 bp, homo sapien
ctcttttcctcttctcmaaagtacctggcatag

SEQ ID NO: 4081 - DNA, 33 bp, homo sapien
atccactaacagcagakatattattaattcatc

SEQ ID NO: 4082 - DNA, 33 bp, homo sapien
tatatagctaaaggtgrcctctgcaaccacttt

SEQ ID NO: 4083 - DNA, 33 bp, homo sapien
aagagcatggttccagraactccacagaagtta

SEQ ID NO: 4084 - DNA, 33 bp, homo sapien
ttgaatcagcactggcwtctcattttggctctg

SEQ ID NO: 4085 - DNA, 33 bp, homo sapien
tacggaagaggaaaaawttaactgtttcaaaag

SEQ ID NO: 4086 - DNA, 33 bp, homo sapien
tgttcacatagaagacratttaggagcctttct

SEQ ID NO: 4087 - DNA, 33 bp, homo sapien
gcttttttgaaaatgaygtgctaagtctcattt

SEQ ID NO: 4088 - DNA, 33 bp, homo sapien
tctaccttacccagtcygccaattcaaatgtca

SEQ ID NO: 4089 - DNA, 33 bp, homo sapien
aattttgctggatatgraattttgggttaacag

SEQ ID NO: 4090 - DNA, 33 bp, homo sapien
ttacttattgtatccaktctgataggtgtgaag

SEQ ID NO: 4091 - DNA, 33 bp, homo sapien
gatataatcagcacctrctgtcaatgtaggcct

SEQ ID NO: 4092 - DNA, 33 bp, homo sapien
ccctttacctgagccawctccccagcctctctc

SEQ ID NO: 4093 - DNA, 33 bp, homo sapien
catttaaaacatgcaaytcaatgatattcaaag

SEQ ID NO: 4094 - DNA, 33 bp, homo sapien
ttataaaatgcagctaytgagagagatgccaga

SEQ ID NO: 4095 - DNA, 33 bp, homo sapien
tgtggatagacatgacrgttttacaatgccaaa

SEQ ID NO: 4096 - DNA, 33 bp, homo sapien
cagtgcagtcctagtcragatggccacacctcc

SEQ ID NO: 4097 - DNA, 33 bp, homo sapien
caacctttctcaaaatytcctttaccacatgaa

SEQ ID NO: 4098 - DNA, 33 bp, homo sapien
atcctagtggccagttrcatttctcatcaatca

SEQ ID NO: 4099 - DNA, 33 bp, homo sapien
cactctgcattttggaygtgccagcttctataa

SEQ ID NO: 4100 - DNA, 33 bp, homo sapien
ctagataaacccaatcmaatcagaaagaatgaa

SEQ ID NO: 4101 - DNA, 33 bp, homo sapien
gcatgctggattccgcrgtgccaaaccaaacag

SEQ ID NO: 4102 - DNA, 33 bp, homo sapien
caagagtgatatcttaygaggttttgctagtca

SEQ ID NO: 4103 - DNA, 33 bp, homo sapien
tggtaggaaagttgccrtgactccacaccagcc

SEQ ID NO: 4104 - DNA, 33 bp, homo sapien
ctgtttcgtgatccgcstgcctggactatcact

SEQ ID NO: 4105 - DNA, 33 bp, homo sapien
gaagtgatgtttaagartaattttcaattacat

SEQ ID NO: 4106 - DNA, 33 bp, homo sapien
taactttgagaggtttsactttgtccaacactc

SEQ ID NO: 4107 - DNA, 33 bp, homo sapien
taagaacgaaaaagcasttcatagcttggagag

SEQ ID NO: 4108 - DNA, 33 bp, homo sapien
ctgagctcatatgataygccaagcattgtgcta

SEQ ID NO: 4109 - DNA, 33 bp, homo sapien
atctattgacatatgayggacataatgaaaaaa

SEQ ID NO: 4110 - DNA, 33 bp, homo sapien
ggcttgtgtctgagctrtgagaaatcccggtct

SEQ ID NO: 4111 - DNA, 33 bp, homo sapien
gaattgcaaatgtcttmccacttgttcgataaa

SEQ ID NO: 4112 - DNA, 33 bp, homo sapien
agattgctccttataayaaaatgaccaaaaaag

SEQ ID NO: 4113 - DNA, 33 bp, homo sapien
gggaatgtgctaccttycaaggctgccagagcc

SEQ ID NO: 4114 - DNA, 33 bp, homo sapien
ctctatgttcagagagygtctaccctcaagttt

SEQ ID NO: 4115 - DNA, 33 bp, homo sapien
ccttctttccacgtctytcagtttctgtgtcaa

SEQ ID NO: 4116 - DNA, 33 bp, homo sapien
ccctcttttgttttttyatgactgcgtactatt

SEQ ID NO: 4117 - DNA, 33 bp, homo sapien
acagtgtcttaattatygtagctatatagtaaa

SEQ ID NO: 4118 - DNA, 33 bp, homo sapien
atttctttcctatcaawttgtgttacaacattt

SEQ ID NO: 4119 - DNA, 33 bp, homo sapien
ttggccactctgtcatkcttgaaaagttttctt

SEQ ID NO: 4120 - DNA, 33 bp, homo sapien
tccctgcttcacactakttattggactatctgc

SEQ ID NO: 4121 - DNA, 33 bp, homo sapien
attacactatccatagrgaagtttgtttgagac

SEQ ID NO: 4122 - DNA, 33 bp, homo sapien
gcttcaaataaaatatratctgtgtatgaataa

SEQ ID NO: 4123 - DNA, 33 bp, homo sapien
aagttaacagcaaagarcaatgtctccaaagtc

SEQ ID NO: 4124 - DNA, 33 bp, homo sapien
gatcccatgatatacaytgaaattagggatcct

SEQ ID NO: 4125 - DNA, 33 bp, homo sapien
ttgcagtgtgactgaayggtactgtgaaacact

SEQ ID NO: 4126 - DNA, 33 bp, homo sapien
tcagacaagggttaaaygtagtggtaagaaaca

SEQ ID NO: 4127 - DNA, 33 bp, homo sapien
aagtcacacgttgtggrcagcaaagccagtgtg

SEQ ID NO: 4128 - DNA, 33 bp, homo sapien
atgttgctgggtattaygaaagcttcaaaagca

SEQ ID NO: 4129 - DNA, 33 bp, homo sapien
gaataagttcaggaaartttagtcgttaccaaa

SEQ ID NO: 4130 - DNA, 33 bp, homo sapien
aaatacacaaggctctygacttacctgagaagg

SEQ ID NO: 4131 - DNA, 33 bp, homo sapien
aagataaaatgttagcstatcaatatttcatgg

SEQ ID NO: 4132 - DNA, 33 bp, homo sapien
gcctttcttaattgtcyacttggagtgtttgcc

SEQ ID NO: 4133 - DNA, 33 bp, homo sapien
ttcctacttaacgttaygccctctcaaaaaatt

SEQ ID NO: 4134 - DNA, 33 bp, homo sapien
atgcatagaacctatartcaacttttaatcccc

SEQ ID NO: 4135 - DNA, 33 bp, homo sapien
ccttcccctcttcctawcaaagcatccaatctg

SEQ ID NO: 4136 - DNA, 33 bp, homo sapien
cacaaagagccttgaawgtactatttcacaggt

SEQ ID NO: 4137 - DNA, 33 bp, homo sapien
tagtaataggacagaastatcattcaatactaa

SEQ ID NO: 4138 - DNA, 33 bp, homo sapien
atgcagcaggccgacartcataggcggcctgtt

SEQ ID NO: 4139 - DNA, 33 bp, homo sapien
aacatttcatttctgtkttgggtcactttcctt

SEQ ID NO: 4140 - DNA, 33 bp, homo sapien
acaaaacagatgtaackctctcccttgattgct

SEQ ID NO: 4141 - DNA, 33 bp, homo sapien
ggcaaaattccagaatkgttccctaagatattc

SEQ ID NO: 4142 - DNA, 33 bp, homo sapien
atgtaattgggaaagayatattcagcatctgga

SEQ ID NO: 4143 - DNA, 33 bp, homo sapien
gaagcttcccaaaaatkcatacaacatgaacaa

SEQ ID NO: 4144 - DNA, 33 bp, homo sapien
gcccgggaaaggaagasaaatggatgtaaggag

SEQ ID NO: 4145 - DNA, 33 bp, homo sapien
tatcaggatctgcttgratatttgaggcacggt

SEQ ID NO: 4146 - DNA, 33 bp, homo sapien
tagcagctaacacatgrcattgggcctgctggt

SEQ ID NO: 4147 - DNA, 33 bp, homo sapien
gctttacttttcctgarcaaacacctctgagct

SEQ ID NO: 4148 - DNA, 33 bp, homo sapien
atgcttcactcagatartcatagtgcccctgta

SEQ ID NO: 4149 - DNA, 33 bp, homo sapien
ctgctcacattttttcygacctcaaaccttaga

SEQ ID NO: 4150 - DNA, 33 bp, homo sapien
aattcgaagtctgattrtcctgagcaggttcct

SEQ ID NO: 4151 - DNA, 33 bp, homo sapien
ggctcttcttacatttkcagtgtgccccatgtc

SEQ ID NO: 4152 - DNA, 33 bp, homo sapien
aacttgagctaaacaargaagataagcgctgac

SEQ ID NO: 4153 - DNA, 33 bp, homo sapien
gacagataatatcatcktccaggagggttccat

SEQ ID NO: 4154 - DNA, 33 bp, homo sapien
taccaatttaaattccmaaaagcagcatctgga

SEQ ID NO: 4155 - DNA, 33 bp, homo sapien
cagcctctaaaaactcmcaaagaacaagaggga

SEQ ID NO: 4156 - DNA, 33 bp, homo sapien
ccgcaaaacaagaaaakgagaatgtagcaatgc

SEQ ID NO: 4157 - DNA, 33 bp, homo sapien
aagaaacttcagagaaygatttcttaagcacta

SEQ ID NO: 4158 - DNA, 33 bp, homo sapien
agataaaaccacaaaaygaggagaaaccagagc

SEQ ID NO: 4159 - DNA, 33 bp, homo sapien
tatctactcagacatasgtgaaaaggctgatgg

SEQ ID NO: 4160 - DNA, 33 bp, homo sapien
caagattcaactaatgraggccagaagccaatg

SEQ ID NO: 4161 - DNA, 33 bp, homo sapien
gcattaaaattctgctkctaaaacagttattac

SEQ ID NO: 4162 - DNA, 33 bp, homo sapien
gttaagccaccgagttkgtggtgatttgttaca

SEQ ID NO: 4163 - DNA, 33 bp, homo sapien
tttaacattcagccagraagatcatgatgaggg

SEQ ID NO: 4164 - DNA, 33 bp, homo sapien
gacagggagcctcattyttcctaaatctgcttt

SEQ ID NO: 4165 - DNA, 33 bp, homo sapien
ttaaggtccaggtcccmttttctctacaggact

SEQ ID NO: 4166 - DNA, 33 bp, homo sapien
gcagttttcctggcagytgtccattccggcctc

SEQ ID NO: 4167 - DNA, 33 bp, homo sapien
aatatagatagatggayatcgagatagagctgg

SEQ ID NO: 4168 - DNA, 33 bp, homo sapien
ctccagtaacctaccaytgaagccaaaattact

SEQ ID NO: 4169 - DNA, 33 bp, homo sapien
ttcttactgggatttcygacattcattccacct

SEQ ID NO: 4170 - DNA, 33 bp, homo sapien
gttctttccacatattygatttgctaattctca

SEQ ID NO: 4171 - DNA, 33 bp, homo sapien
ttatgaataatatcgcyggctgtttacatacat

SEQ ID NO: 4172 - DNA, 33 bp, homo sapien
tgtcctgctataacttygtagtcctggatgctg

SEQ ID NO: 4173 - DNA, 33 bp, homo sapien
ccatcctttcttcaatrtaagttctcagcacat

SEQ ID NO: 4174 - DNA, 33 bp, homo sapien
gagccaatcataaagayggtaaagagtctattt

SEQ ID NO: 4175 - DNA, 33 bp, homo sapien
accgaggtatgaaactrtcacacgcaggctcaa

SEQ ID NO: 4176 - DNA, 33 bp, homo sapien
gccatgtgaggacatamcaggaaaaggccctca

SEQ ID NO: 4177 - DNA, 33 bp, homo sapien
tcaggagtgcattttgrtcatgttaaattttaa

SEQ ID NO: 4178 - DNA, 33 bp, homo sapien
gagggtaacatctacgkatctgtggaggtgagc

SEQ ID NO: 4179 - DNA, 33 bp, homo sapien
cttagtttagatgaaargaatcactcctatttc

SEQ ID NO: 4180 - DNA, 33 bp, homo sapien
catcaataaatggctamgtcaaaaaagtaggaa

SEQ ID NO: 4181 - DNA, 33 bp, homo sapien
gaagaagagtgggaagscttgattataggcaga

SEQ ID NO: 4182 - DNA, 33 bp, homo sapien
aggttgtctgaaaagawactaagcacgtgcacc

SEQ ID NO: 4183 - DNA, 33 bp, homo sapien
gtaggtgagtcatgtayagtataaaggattata

SEQ ID NO: 4184 - DNA, 33 bp, homo sapien
agatctggcacactgcrgtaccctgtaaatatt

SEQ ID NO: 4185 - DNA, 33 bp, homo sapien
atgtatggccagagaaytgaaaatggcttatca

SEQ ID NO: 4186 - DNA, 33 bp, homo sapien
gagggtcaaagaggtcrctttactttcctaaac

SEQ ID NO: 4187 - DNA, 33 bp, homo sapien
acaataccaacattaaratgcagccaatttctc

SEQ ID NO: 4188 - DNA, 33 bp, homo sapien
acggcccttaattttgktttgaaaagccagggc

SEQ ID NO: 4189 - DNA, 33 bp, homo sapien
ttgggactttggtcttyggcctcctgcttccac

SEQ ID NO: 4190 - DNA, 33 bp, homo sapien
aatattatgtgtcttayaacttttagccattct

SEQ ID NO: 4191 - DNA, 33 bp, homo sapien
gtttgctctcactcttmatacaatcgccaaaat

SEQ ID NO: 4192 - DNA, 33 bp, homo sapien
aacattggaaagccagrtgggagtgactggaac

SEQ ID NO: 4193 - DNA, 33 bp, homo sapien
tgtaacaatcaggtgtraattctgaaacagatg

SEQ ID NO: 4194 - DNA, 33 bp, homo sapien
ttgtattgctaaactaygcaggccctcttggct

SEQ ID NO: 4195 - DNA, 33 bp, homo sapien
ggcttctatacttgttycctggccagccttccc

SEQ ID NO: 4196 - DNA, 33 bp, homo sapien
tgggaggtgtggctgascatccaaaggaaagcc

SEQ ID NO: 4197 - DNA, 33 bp, homo sapien
cagtgggccttccataraagtttgttgaatgaa

SEQ ID NO: 4198 - DNA, 33 bp, homo sapien
ctgcttcccacttctcrcttctgcctctgcttc

SEQ ID NO: 4199 - DNA, 33 bp, homo sapien
tttctaattcttcctcrctatcttcacagaaat

SEQ ID NO: 4200 - DNA, 33 bp, homo sapien
atgctaattctacaccwattcttccaaaaagtt

SEQ ID NO: 4201 - DNA, 33 bp, homo sapien
aaattgctctgtctatsggtctcacttccaaag

SEQ ID NO: 4202 - DNA, 33 bp, homo sapien
atataatggtagctgtrgtttattgagtactga

SEQ ID NO: 4203 - DNA, 33 bp, homo sapien
cattgactatgggaagmcttctgcattgaactt

SEQ ID NO: 4204 - DNA, 33 bp, homo sapien
tgtgcctgaggctcacrtgacctctgcacttgc

SEQ ID NO: 4205 - DNA, 33 bp, homo sapien
ccattctgttcctcagscttctggacccgtctg

SEQ ID NO: 4206 - DNA, 33 bp, homo sapien
gaaccagtctcaggccrgtcactttctttttta

SEQ ID NO: 4207 - DNA, 33 bp, homo sapien
acacataacacttaccrtttatcatttttgagt

SEQ ID NO: 4208 - DNA, 33 bp, homo sapien
tcggttgtagacataayatgcttattttgtgga

SEQ ID NO: 4209 - DNA, 33 bp, homo sapien
aggtacaattacacccrtctgtggaaaattgcc

SEQ ID NO: 4210 - DNA, 33 bp, homo sapien
agtagcagtttatatayaggcttatggtttata

SEQ ID NO: 4211 - DNA, 33 bp, homo sapien
tttttaagcaaagtatycagctaattttggaca

SEQ ID NO: 4212 - DNA, 33 bp, homo sapien
ttaataaactcatcatygcatttgctttataga

SEQ ID NO: 4213 - DNA, 33 bp, homo sapien
gggtggtccggaatggyggaagtaaatcgacag

SEQ ID NO: 4214 - DNA, 33 bp, homo sapien
tcaaggttgactcttcyacattctatgggacat

SEQ ID NO: 4215 - DNA, 33 bp, homo sapien
accatcagatagactaygcattctcttatttat

SEQ ID NO: 4216 - DNA, 33 bp, homo sapien
aagggctaaagtttacrtcataaagtgtcaatg

SEQ ID NO: 4217 - DNA, 33 bp, homo sapien
ccggcacttttgccatkgtcctggtgtgttacc

SEQ ID NO: 4218 - DNA, 33 bp, homo sapien
aaatcactttgtcagakccttatcccagctgga

SEQ ID NO: 4219 - DNA, 33 bp, homo sapien
aatttcctgagcaatastggtgctaagtatatc

SEQ ID NO: 4220 - DNA, 33 bp, homo sapien
tgtcaaatatatatttytcttaacgacctgttt

SEQ ID NO: 4221 - DNA, 33 bp, homo sapien
caaaacgaggtgcaatkataagttaacatctag

SEQ ID NO: 4222 - DNA, 33 bp, homo sapien
tgcttctctgggcgagwctcatggattctttga

SEQ ID NO: 4223 - DNA, 33 bp, homo sapien
aaggatttgggagatayttcagagggagaagca

SEQ ID NO: 4224 - DNA, 33 bp, homo sapien
caaatcagcctgccaakgttccaataaatgctg

SEQ ID NO: 4225 - DNA, 33 bp, homo sapien
ggacgctgttaaaaatyacccaattgtgaaaaa

SEQ ID NO: 4226 - DNA, 33 bp, homo sapien
taattttgtagaaaggwgtgatgtgatctgatt

SEQ ID NO: 4227 - DNA, 33 bp, homo sapien
aaacaaaacaaaaaaasttgagtgcttactatg

SEQ ID NO: 4228 - DNA, 33 bp, homo sapien
tttctttcttcctgccrtctttttggaatttta

SEQ ID NO: 4229 - DNA, 33 bp, homo sapien
tgtgagtgacgtgtttytcctggtaacaaatag

SEQ ID NO: 4230 - DNA, 33 bp, homo sapien
taaggtagccagtgagsaccctaggaggaaggt

SEQ ID NO: 4231 - DNA, 33 bp, homo sapien
tctgttctctcactgcyactaatttagagcttt

SEQ ID NO: 4232 - DNA, 33 bp, homo sapien
tccgacctctgcagacrtgtggagaccaagtct

SEQ ID NO: 4233 - DNA, 33 bp, homo sapien
tgccaacgaacctactrttttgacaggtatacc

SEQ ID NO: 4234 - DNA, 33 bp, homo sapien
agggtggaagaggaaaygatgctgaagactgag

SEQ ID NO: 4235 - DNA, 33 bp, homo sapien
ttaagacatatagcacragtgatacatatttga

SEQ ID NO: 4236 - DNA, 33 bp, homo sapien
tgtttttaaactcaagwcttcctcatagcatcc

SEQ ID NO: 4237 - DNA, 33 bp, homo sapien
tattttaacaaattccrtgattgtcagttacct

SEQ ID NO: 4238 - DNA, 33 bp, homo sapien
tgaacacggatttgaayatgtgatatgaacaag

SEQ ID NO: 4239 - DNA, 33 bp, homo sapien
ggaaacaatttttacaragaccaaagaacatta

SEQ ID NO: 4240 - DNA, 33 bp, homo sapien
tttctcttttagcagcyctattccagaaactta

SEQ ID NO: 4241 - DNA, 33 bp, homo sapien
cgttattccccaccagygtgtttttctctgagg

SEQ ID NO: 4242 - DNA, 33 bp, homo sapien
taatttccttgagcacrgtaaggagagtaagga

SEQ ID NO: 4243 - DNA, 33 bp, homo sapien
tttgacccttgaatggmatttctggaccaggtc

SEQ ID NO: 4244 - DNA, 33 bp, homo sapien
gcactatgcctgtgatktgactaacttttataa

SEQ ID NO: 4245 - DNA, 33 bp, homo sapien
attgccagcactgcaamcatacttcttccagat

SEQ ID NO: 4246 - DNA, 33 bp, homo sapien
ggagcggacaccagagyaggatgagctgaaagc

SEQ ID NO: 4247 - DNA, 33 bp, homo sapien
agcagttagagaggtcyggcatgtgaggaagaa

SEQ ID NO: 4248 - DNA, 33 bp, homo sapien
ttgtcagtgaccatatkttgcctgtttctggaa

SEQ ID NO: 4249 - DNA, 33 bp, homo sapien
ctcccaagatagctctrcttgaccttcatctct

SEQ ID NO: 4250 - DNA, 33 bp, homo sapien
tttcagttttatggttygatacatttcagtaaa

SEQ ID NO: 4251 - DNA, 33 bp, homo sapien
accatggaaaaagggcytgacaaatgatgccct

SEQ ID NO: 4252 - DNA, 33 bp, homo sapien
ttttactacaatcaacrgaataatgtagtttta

SEQ ID NO: 4253 - DNA, 33 bp, homo sapien
tgtagaaggggtttgakttgagccaggatggga

SEQ ID NO: 4254 - DNA, 33 bp, homo sapien
tctctctcactcatctytgtaacagttcaagta

SEQ ID NO: 4255 - DNA, 33 bp, homo sapien
tgctccaacacaatacraagagctgtatttttc

SEQ ID NO: 4256 - DNA, 33 bp, homo sapien
tttaacaaggtcttcarcattttaacctgccat

SEQ ID NO: 4257 - DNA, 33 bp, homo sapien
gactatccttggtccaytgacttatcttggcac

SEQ ID NO: 4258 - DNA, 33 bp, homo sapien
gattactacctgtgtgwccttggagaaatagct

SEQ ID NO: 4259 - DNA, 33 bp, homo sapien
gttgtagatagccttaygtttctttttgtttat

SEQ ID NO: 4260 - DNA, 33 bp, homo sapien
atatcatgtggaacagkgaaagatattttcaaa

SEQ ID NO: 4261 - DNA, 33 bp, homo sapien
tcaagctgtcatgtggygttactgactggagtc

SEQ ID NO: 4262 - DNA, 33 bp, homo sapien
aagtttagcaatatttmtgactgcctggtagat

SEQ ID NO: 4263 - DNA, 33 bp, homo sapien
ttctacacagaggatcrtgtcatctacaaacaa

SEQ ID NO: 4264 - DNA, 33 bp, homo sapien
taactccaatgacaaaygtccttataaatgaga

SEQ ID NO: 4265 - DNA, 33 bp, homo sapien
caacaactgagtattgstaacatacattaaaca

SEQ ID NO: 4266 - DNA, 33 bp, homo sapien
gagccatgtggcatgtmtcgtggcaatctttat

SEQ ID NO: 4267 - DNA, 33 bp, homo sapien
ccacaggaatttgcaayacttacacattttacc

SEQ ID NO: 4268 - DNA, 33 bp, homo sapien
acaggaaaaatgtgaamatggtacttacaaatt

SEQ ID NO: 4269 - DNA, 33 bp, homo sapien
cacattcacctttcttygtgtacctgctgagct

SEQ ID NO: 4270 - DNA, 33 bp, homo sapien
atttaggacctggcctygatactaaattctgct

SEQ ID NO: 4271 - DNA, 33 bp, homo sapien
agttttctgtcaaagtrggatgagatttataca

SEQ ID NO: 4272 - DNA, 33 bp, homo sapien
tctgggagctgtggacwttccttgcactgcttc

SEQ ID NO: 4273 - DNA, 33 bp, homo sapien
catatagtttatggccwatttgctacagcagtt

SEQ ID NO: 4274 - DNA, 33 bp, homo sapien
ttcagctacccattatyaattaccttctttagg

SEQ ID NO: 4275 - DNA, 33 bp, homo sapien
cctgcgagctggagacscgagaaagccagggtt

SEQ ID NO: 4276 - DNA, 33 bp, homo sapien
ttgtttagtttgcaccrttgttcctgttgttgg

SEQ ID NO: 4277 - DNA, 33 bp, homo sapien
aacaaacttaacatacrgtaagcaatcaatcaa

SEQ ID NO: 4278 - DNA, 33 bp, homo sapien
agcagataggagagaarcaacgaagatataaga

SEQ ID NO: 4279 - DNA, 33 bp, homo sapien
gtattgctgtttctcawtgattctcacaacaca

SEQ ID NO: 4280 - DNA, 33 bp, homo sapien
gtgtatgcttaaccggmgttctcaccattcaaa

SEQ ID NO: 4281 - DNA, 33 bp, homo sapien
cttttatagagaaaacrctgtattggttaattt

SEQ ID NO: 4282 - DNA, 33 bp, homo sapien
atcaagcagaagaacgmatgagcgagcttgaag

SEQ ID NO: 4283 - DNA, 33 bp, homo sapien
gtgggaaataaataccsagcataaggcattgtg

SEQ ID NO: 4284 - DNA, 33 bp, homo sapien
aaaatagttggttcacscaaaattgaactgcct

SEQ ID NO: 4285 - DNA, 33 bp, homo sapien
taaattatagtggaccrtcaacttatgatacct

SEQ ID NO: 4286 - DNA, 33 bp, homo sapien
tgtttcaaaagtgctargaatataaatatccag

SEQ ID NO: 4287 - DNA, 33 bp, homo sapien
tctaacaaacatgaatraaacctagtaaaatct

SEQ ID NO: 4288 - DNA, 33 bp, homo sapien
tacaattgctaaatctsttgcacaggtatctca

SEQ ID NO: 4289 - DNA, 33 bp, homo sapien
agcaggtaagattacaygaagagttaaagaata

SEQ ID NO: 4290 - DNA, 33 bp, homo sapien
acatagataatccaggwtattctccttatatga

SEQ ID NO: 4291 - DNA, 33 bp, homo sapien
tagatgcagaaactacrgccttgttctttgcaa

SEQ ID NO: 4292 - DNA, 33 bp, homo sapien
caacaccctccacaacmatttctttttttgttt

SEQ ID NO: 4293 - DNA, 33 bp, homo sapien
aacttttgttgtcctcygattttatcatagcat

SEQ ID NO: 4294 - DNA, 33 bp, homo sapien
agcctgggcttccaagyattctgattttccctg

SEQ ID NO: 4295 - DNA, 33 bp, homo sapien
ccctaagcttccctcakaacattgcacacgtgt

SEQ ID NO: 4296 - DNA, 33 bp, homo sapien
gacatcacttggcaaarctagtgatggaggcat

SEQ ID NO: 4297 - DNA, 33 bp, homo sapien
atagttttgagcatcarggaatacattttcaga

SEQ ID NO: 4298 - DNA, 33 bp, homo sapien
ctaagttgaaaatatgrtcaatccaagatgcat

SEQ ID NO: 4299 - DNA, 33 bp, homo sapien
cctggatctgacccagmgaccagaggcacaaac

SEQ ID NO: 4300 - DNA, 33 bp, homo sapien
aggatagtgttttcttyaggtgtaagtagtttg

SEQ ID NO: 4301 - DNA, 33 bp, homo sapien
tgatagatcttattatsaggcatatatgcataa

SEQ ID NO: 4302 - DNA, 33 bp, homo sapien
tgcaagaggcaagagayaacctgaaggaatgac

SEQ ID NO: 4303 - DNA, 33 bp, homo sapien
caatggaataggagcayggaggccaagttagct

SEQ ID NO: 4304 - DNA, 33 bp, homo sapien
tctcaggctgctccttyctcgggctgcctaccc

SEQ ID NO: 4305 - DNA, 33 bp, homo sapien
ttttcaattcatgcttsgttgaatccacagatg

SEQ ID NO: 4306 - DNA, 33 bp, homo sapien
tgagagttgtcacccartggcagttgaaattag

SEQ ID NO: 4307 - DNA, 33 bp, homo sapien
atagataaataccaagraacacaattgctggat

SEQ ID NO: 4308 - DNA, 33 bp, homo sapien
tgaaccttgagagtggragattattttggagta

SEQ ID NO: 4309 - DNA, 33 bp, homo sapien
ttatagttccttaatakttttttacatgcctgt

SEQ ID NO: 4310 - DNA, 33 bp, homo sapien
gacttggaaactcttcsctttggagcagcagca

SEQ ID NO: 4311 - DNA, 33 bp, homo sapien
atttttttgaattcttscaatatgttaaaagcc

SEQ ID NO: 4312 - DNA, 33 bp, homo sapien
aaaacaccaagtggagraattgaagatccctga

SEQ ID NO: 4313 - DNA, 33 bp, homo sapien
gctgagccactagaacratggtgctggagaaag

SEQ ID NO: 4314 - DNA, 33 bp, homo sapien
cactatggaagagagcygttttctacctacttt

SEQ ID NO: 4315 - DNA, 33 bp, homo sapien
tttagtctcatcacaawttctgttttagaaaaa

SEQ ID NO: 4316 - DNA, 33 bp, homo sapien
agatctccaggaaaatrttgccttcttattggt

SEQ ID NO: 4317 - DNA, 33 bp, homo sapien
cagtaaatatatagtgwaaaaaactgggttgat

SEQ ID NO: 4318 - DNA, 33 bp, homo sapien
agagatgataatgaagyattcctggccatttta

SEQ ID NO: 4319 - DNA, 33 bp, homo sapien
aaaacaaagagtttgcmgtttgctccttaccca

SEQ ID NO: 4320 - DNA, 33 bp, homo sapien
aagtatctttctgggcrctattatatacaatac

SEQ ID NO: 4321 - DNA, 33 bp, homo sapien
ttagggctccatttacytctcgtatattgttct

SEQ ID NO: 4322 - DNA, 33 bp, homo sapien
tttataaagcactaacrataggccaggcattat

SEQ ID NO: 4323 - DNA, 33 bp, homo sapien
tttaccctttcccattytactcaaagcatgatt

SEQ ID NO: 4324 - DNA, 33 bp, homo sapien
gaataaacaaggattcytaaatctcaaaatgtc

SEQ ID NO: 4325 - DNA, 33 bp, homo sapien
tcttcaagtcaacattrtttattcactaaaacc

SEQ ID NO: 4326 - DNA, 33 bp, homo sapien
tgaggctccgattgtayttctaataagctccca

SEQ ID NO: 4327 - DNA, 33 bp, homo sapien
attctgatttttgcacsaatgagggacacgagg

SEQ ID NO: 4328 - DNA, 33 bp, homo sapien
tagagtgctacatatargtcaatctgaaaaggt

SEQ ID NO: 4329 - DNA, 33 bp, homo sapien
tctacatggcttaaatrtctctagctaatacct

SEQ ID NO: 4330 - DNA, 33 bp, homo sapien
atttgtaagaataagartggtacgtagaacacc

SEQ ID NO: 4331 - DNA, 33 bp, homo sapien
ttatcaacttatacctrtcatatagcacagcat

SEQ ID NO: 4332 - DNA, 33 bp, homo sapien
tgatcgaggctgtcagrccatgagaggaagcaa

SEQ ID NO: 4333 - DNA, 33 bp, homo sapien
tttaaaccacagataarcttaccattagaagta

SEQ ID NO: 4334 - DNA, 33 bp, homo sapien
caccatttaccaaggcygtgaaagtatgctggt

SEQ ID NO: 4335 - DNA, 33 bp, homo sapien
tttctagctaaaaatcmtgatcactaagtggtt

SEQ ID NO: 4336 - DNA, 33 bp, homo sapien
acagaaagataaaagtygggtcgaaaaagataa

SEQ ID NO: 4337 - DNA, 33 bp, homo sapien
aatcctcaaaacctgcraatatgttatcttacg

SEQ ID NO: 4338 - DNA, 33 bp, homo sapien
ccacttcacaccataaratgatacattctatgg

SEQ ID NO: 4339 - DNA, 33 bp, homo sapien
cttaaggaaggaaagaractggcatgttataag

SEQ ID NO: 4340 - DNA, 33 bp, homo sapien
gtagctatgggggtggyttaatgacatagcagc

SEQ ID NO: 4341 - DNA, 33 bp, homo sapien
ggctgtcaggaagttgmgttttgaatatgctca

SEQ ID NO: 4342 - DNA, 33 bp, homo sapien
ctgtaaaaggagacaamaatagagctgttggga

SEQ ID NO: 4343 - DNA, 33 bp, homo sapien
gaggttttactgtctamtgcccagaggtgaagc

SEQ ID NO: 4344 - DNA, 33 bp, homo sapien
ggtgctggtatattctrtcatttagagaggtct

SEQ ID NO: 4345 - DNA, 33 bp, homo sapien
tgcttctattttgagcsttttttgactttcttt

SEQ ID NO: 4346 - DNA, 33 bp, homo sapien
ggagaaagatctatcawgcaaaactgaacacaa

SEQ ID NO: 4347 - DNA, 33 bp, homo sapien
tcatttggaaatctacmtgccactgtcacaaat

SEQ ID NO: 4348 - DNA, 33 bp, homo sapien
caatgagatatatatamgatagcatcaataaac

SEQ ID NO: 4349 - DNA, 33 bp, homo sapien
acatgtaattcctgacrttgagcttcactgtgt

SEQ ID NO: 4350 - DNA, 33 bp, homo sapien
ggctcaggttgccaagygccacccttccattga

SEQ ID NO: 4351 - DNA, 33 bp, homo sapien
ggcagagctcttgttayctaaccatcttccaaa

SEQ ID NO: 4352 - DNA, 33 bp, homo sapien
gactcctacacccatcytcagagctccaggttc

SEQ ID NO: 4353 - DNA, 33 bp, homo sapien
ctctggcatatgaaccrtttacttctaaaataa

SEQ ID NO: 4354 - DNA, 33 bp, homo sapien
tttggtatagaagtatytgaattttattctgtg

SEQ ID NO: 4355 - DNA, 33 bp, homo sapien
tcccaagaaggcaaaasagatgagagcaaaatg

SEQ ID NO: 4356 - DNA, 33 bp, homo sapien
agctgtattattagggwtttaggtcagtcaatg

SEQ ID NO: 4357 - DNA, 33 bp, homo sapien
gccttggaagtaataasaaaccagaaacaggtt

SEQ ID NO: 4358 - DNA, 33 bp, homo sapien
ggtcataaggacagaargtatttgttgttgttg

SEQ ID NO: 4359 - DNA, 33 bp, homo sapien
atattcactcttgaatmactaataggagttttg

SEQ ID NO: 4360 - DNA, 33 bp, homo sapien
taggagctttgtgatcygcttggctgacctgga

SEQ ID NO: 4361 - DNA, 33 bp, homo sapien
gtccgcaatcaggtggygaacatcccgtccttc

SEQ ID NO: 4362 - DNA, 33 bp, homo sapien
cttattttcagcatctktgagattatttcatta

SEQ ID NO: 4363 - DNA, 33 bp, homo sapien
tggccctaatcagtgcmttctaataggaggtac

SEQ ID NO: 4364 - DNA, 33 bp, homo sapien
tagacagctagaggatygaaggccaacccactc

SEQ ID NO: 4365 - DNA, 33 bp, homo sapien
tatctgggtcagctttstctcccattctggcat

SEQ ID NO: 4366 - DNA, 33 bp, homo sapien
atttaatctgtggatcmatttgaacatactgga

SEQ ID NO: 4367 - DNA, 33 bp, homo sapien
atcattccctgggattmgtctccaggcatgatt

SEQ ID NO: 4368 - DNA, 33 bp, homo sapien
aggactactttacctgytctttcacttatttgt

SEQ ID NO: 4369 - DNA, 33 bp, homo sapien
ggaggggcagatggcakgaagtaatctttctgc

SEQ ID NO: 4370 - DNA, 33 bp, homo sapien
atacaagcgtatgaaasaagattcacaaacaga

SEQ ID NO: 4371 - DNA, 33 bp, homo sapien
tggattatggccatacycttcatttttgtaatg

SEQ ID NO: 4372 - DNA, 33 bp, homo sapien
gcctgagctcttagttycaagaaccgtagtaaa

SEQ ID NO: 4373 - DNA, 33 bp, homo sapien
tatcataacataatcartttagatgcagacatg

SEQ ID NO: 4374 - DNA, 33 bp, homo sapien
taagaggacaggaaagrcagtcataaatttctg

SEQ ID NO: 4375 - DNA, 33 bp, homo sapien
gttagttgtctgtaatkatttagttttaatttt

SEQ ID NO: 4376 - DNA, 33 bp, homo sapien
gagttgggttaggagamcaggcaaaatctatgg

SEQ ID NO: 4377 - DNA, 33 bp, homo sapien
catattccgtaacgcargtagagtacactcaga

SEQ ID NO: 4378 - DNA, 33 bp, homo sapien
cagtttcttcatgcatrtccacatcaggcagta

SEQ ID NO: 4379 - DNA, 33 bp, homo sapien
tataacactagtatttmagacactatttgcaaa

SEQ ID NO: 4380 - DNA, 33 bp, homo sapien
atttataggcacttagygaatggagagaaaatc

SEQ ID NO: 4381 - DNA, 33 bp, homo sapien
gcaactgccactaattygagttttcatttaaaa

SEQ ID NO: 4382 - DNA, 33 bp, homo sapien
caaataacacaactgtrgggtctgaagacaata

SEQ ID NO: 4383 - DNA, 33 bp, homo sapien
aacaagcttagatttcygcttcaggatgaaaat

SEQ ID NO: 4384 - DNA, 33 bp, homo sapien
actagtaatattaagakgctttatacacttctt

SEQ ID NO: 4385 - DNA, 33 bp, homo sapien
gtagtcacaataggacrctcagctaatgacttt

SEQ ID NO: 4386 - DNA, 33 bp, homo sapien
tgaataacaagagttawgtgtctctgacccagg

SEQ ID NO: 4387 - DNA, 33 bp, homo sapien
gaacaaaggagcttcartgaataaaacttttct

SEQ ID NO: 4388 - DNA, 33 bp, homo sapien
tctcttttatcattcayctaaagacccactcat

SEQ ID NO: 4389 - DNA, 33 bp, homo sapien
taaatactattccaaaracaatgcccgcaattg

SEQ ID NO: 4390 - DNA, 33 bp, homo sapien
gaagaatgcagttttargatgcagaattatacc

SEQ ID NO: 4391 - DNA, 33 bp, homo sapien
ggatacagccagggtcrttgccatcccacaacc

SEQ ID NO: 4392 - DNA, 33 bp, homo sapien
tgtatagtctattcagktatctaaacaagggga

SEQ ID NO: 4393 - DNA, 33 bp, homo sapien
cataaagtagtttgcaytgtgcctggcacatag

SEQ ID NO: 4394 - DNA, 33 bp, homo sapien
ttcaggcgtaaaattayctgcaatttgtgagca

SEQ ID NO: 4395 - DNA, 33 bp, homo sapien
ctcctgaattgcttctyggtctgtaaatccaag

SEQ ID NO: 4396 - DNA, 33 bp, homo sapien
ttaagctggaaagtttktgtcaatttattaaag

SEQ ID NO: 4397 - DNA, 33 bp, homo sapien
atgtctggaagttttcyctacctaacactttca

SEQ ID NO: 4398 - DNA, 33 bp, homo sapien
tgtatttacctggacarttcttccaatgcaagt

SEQ ID NO: 4399 - DNA, 33 bp, homo sapien
ctctcagaaaaagaccrcctaagatcagggcaa

SEQ ID NO: 4400 - DNA, 33 bp, homo sapien
aagacacagacggggcwaggccactttttgaac

SEQ ID NO: 4401 - DNA, 33 bp, homo sapien
catcttagctccacttrtctggaatacagctcc

SEQ ID NO: 4402 - DNA, 33 bp, homo sapien
cttacacattttactcrttctttactgagttct

SEQ ID NO: 4403 - DNA, 33 bp, homo sapien
ttactaaaggcactgtytgacaaaactttatta

SEQ ID NO: 4404 - DNA, 33 bp, homo sapien
gatgaagctcaagtacyggagttcccaatggta

SEQ ID NO: 4405 - DNA, 33 bp, homo sapien
cctggacagtacagaaytctttaattataccag

SEQ ID NO: 4406 - DNA, 33 bp, homo sapien
aatccacataaagtagrtaaatgttcctaaata

SEQ ID NO: 4407 - DNA, 33 bp, homo sapien
tcgtggcagtgatatamcacaatttgttcaaca

SEQ ID NO: 4408 - DNA, 33 bp, homo sapien
tcctggaaagttaggcratgagtccactaaatg

SEQ ID NO: 4409 - DNA, 33 bp, homo sapien
ctgtggtgtcattgtaygatttatacctgaaag

SEQ ID NO: 4410 - DNA, 33 bp, homo sapien
aaatgagataatcctcrtaaatccctaagcact

SEQ ID NO: 4411 - DNA, 33 bp, homo sapien
ttttaatttgtgtttcyctaattgctagtgagg

SEQ ID NO: 4412 - DNA, 33 bp, homo sapien
atgacagagttatcaaratgaatgctacaatac

SEQ ID NO: 4413 - DNA, 33 bp, homo sapien
ctcctcaaattagttawctccaaattttcttgt

SEQ ID NO: 4414 - DNA, 33 bp, homo sapien
attgcttatccagcaasggatgatgtgcttttg

SEQ ID NO: 4415 - DNA, 33 bp, homo sapien
gcttttcttcaaaccartatcacaaatggatgc

SEQ ID NO: 4416 - DNA, 33 bp, homo sapien
ctgccactcaggatgcyggatgacgggcaggag

SEQ ID NO: 4417 - DNA, 33 bp, homo sapien
catgctggtcctttgayctaggattatcttctc

SEQ ID NO: 4418 - DNA, 33 bp, homo sapien
cattacttgtaatagcraaatgtccttcacttt

SEQ ID NO: 4419 - DNA, 33 bp, homo sapien
ggccagatggttttacratgaaactgttccact

SEQ ID NO: 4420 - DNA, 33 bp, homo sapien
tttgagactgaaaatartcatcatctccaaaat

SEQ ID NO: 4421 - DNA, 33 bp, homo sapien
gtagatcactatactcstaaagaaataaaatga

SEQ ID NO: 4422 - DNA, 33 bp, homo sapien
ggttttggtgtacagawtattttaccacctagg

SEQ ID NO: 4423 - DNA, 33 bp, homo sapien
tagactctgatgcatayggaattgtgactctct

SEQ ID NO: 4424 - DNA, 33 bp, homo sapien
ctcttctcagtttttaygtcacttaaatgtgaa

SEQ ID NO: 4425 - DNA, 33 bp, homo sapien
ttttggtacatatttarcagaggagttcaggca

SEQ ID NO: 4426 - DNA, 33 bp, homo sapien
atgagaaagcaagacaygaagagatcacaactc

SEQ ID NO: 4427 - DNA, 33 bp, homo sapien
gcagtaatatcccttcrccatcattgttccagg

SEQ ID NO: 4428 - DNA, 33 bp, homo sapien
tgtgattattaaagctyagttttttgctgtaga

SEQ ID NO: 4429 - DNA, 33 bp, homo sapien
cctttggcacctccaayagttttgctccactga

SEQ ID NO: 4430 - DNA, 33 bp, homo sapien
ctacctctagcctcaamttttcctttgaactct

SEQ ID NO: 4431 - DNA, 33 bp, homo sapien
agccctctggagatctkgtctttatcagaccat

SEQ ID NO: 4432 - DNA, 33 bp, homo sapien
tttaccccctgtggacytcatttttcttgtttg

SEQ ID NO: 4433 - DNA, 33 bp, homo sapien
tgaagtgagaactccargtagaagcaggcagta

SEQ ID NO: 4434 - DNA, 33 bp, homo sapien
cccaccctcagagtttyggaatcagtaggtctg

SEQ ID NO: 4435 - DNA, 33 bp, homo sapien
ttcctgggaataagctsgatgtgaaggctttta

SEQ ID NO: 4436 - DNA, 33 bp, homo sapien
tgtattgttttaaaccyggtaagagaggatgag

SEQ ID NO: 4437 - DNA, 33 bp, homo sapien
gcagtcattttgaaaarcgacacagcacaggaa

SEQ ID NO: 4438 - DNA, 33 bp, homo sapien
cgaaattcatcgccatrtccaggctcctgggtc

SEQ ID NO: 4439 - DNA, 33 bp, homo sapien
ccaatggtctcactaaytgatatgtcaataata

SEQ ID NO: 4440 - DNA, 33 bp, homo sapien
tacaagaaaattgagtytgaattaatttctgcc

SEQ ID NO: 4441 - DNA, 33 bp, homo sapien
gcagtgaatatgtgacytggagtctgcacaatt

SEQ ID NO: 4442 - DNA, 33 bp, homo sapien
tttgtgcacatttgccygcaccttccatgcagc

SEQ ID NO: 4443 - DNA, 33 bp, homo sapien
ttggaaaagcttcatartagtttctccatgtca

SEQ ID NO: 4444 - DNA, 33 bp, homo sapien
tactgtgtttctctctmtatatatgcacatcta

SEQ ID NO: 4445 - DNA, 33 bp, homo sapien
tagcaacttacactgastctctcagttcctaca

SEQ ID NO: 4446 - DNA, 33 bp, homo sapien
tatcagaaatattgtcmcatctaatttgcaagc

SEQ ID NO: 4447 - DNA, 33 bp, homo sapien
tattaagaaaccataawctggaaggtaaatagt

SEQ ID NO: 4448 - DNA, 33 bp, homo sapien
gcctagagggaaaacaycaagacaaaaatgaaa

SEQ ID NO: 4449 - DNA, 33 bp, homo sapien
aagacttcaccctaacsttttattcaagccatc

SEQ ID NO: 4450 - DNA, 33 bp, homo sapien
gctggttttgtactccmacatgctctatagtga

SEQ ID NO: 4451 - DNA, 33 bp, homo sapien
gctcatttatctgaaaytagagttcgtatgtaa

SEQ ID NO: 4452 - DNA, 33 bp, homo sapien
atgaaaatgtgctgttwtcagatgtgcagtgtc

SEQ ID NO: 4453 - DNA, 33 bp, homo sapien
ctaacctctgtaacagsacatagcacatccgcc

SEQ ID NO: 4454 - DNA, 33 bp, homo sapien
ctttttaatgtagaaargccatattttatgaag

SEQ ID NO: 4455 - DNA, 33 bp, homo sapien
cagggtcactggaaatwccctcacaatcacctg

SEQ ID NO: 4456 - DNA, 33 bp, homo sapien
aatgacatcttgtgttyatgatattctgtcttc

SEQ ID NO: 4457 - DNA, 33 bp, homo sapien
tgtggatcgaacagtayggcaatgtggaaatta

SEQ ID NO: 4458 - DNA, 33 bp, homo sapien
tcatttagctgatttaractcaatgtaacaaat

SEQ ID NO: 4459 - DNA, 33 bp, homo sapien
tggcaggatgctattgkctttccctcgctagca

SEQ ID NO: 4460 - DNA, 33 bp, homo sapien
accaaacaggcagttawgaagatgaagcaaaat

SEQ ID NO: 4461 - DNA, 33 bp, homo sapien
ctcctttgaaagacaamgtgctaccatttcttc

SEQ ID NO: 4462 - DNA, 33 bp, homo sapien
tcttttgccaacatttktactcctctctaattg

SEQ ID NO: 4463 - DNA, 33 bp, homo sapien
tttgtctttccagaagkcttcccaagggactgg

SEQ ID NO: 4464 - DNA, 33 bp, homo sapien
cgtgtgattgtccaggygaacttgtgggaactg

SEQ ID NO: 4465 - DNA, 33 bp, homo sapien
atgcaatacacagatgytctcctatttaatcac

SEQ ID NO: 4466 - DNA, 33 bp, homo sapien
ctgagaagatatgactygtaactttccaataac

SEQ ID NO: 4467 - DNA, 33 bp, homo sapien
tagcattgttcttactsctagatatttgatctt

SEQ ID NO: 4468 - DNA, 33 bp, homo sapien
agactttgaacaagatragttgagattaaacac

SEQ ID NO: 4469 - DNA, 33 bp, homo sapien
gcgtgatcatggactayttcatgtcttaagtta

SEQ ID NO: 4470 - DNA, 33 bp, homo sapien
taccttaaattcctgcsagctgtgagcctgtga

SEQ ID NO: 4471 - DNA, 33 bp, homo sapien
acatgacctcactacaractaaacaaggtacca

SEQ ID NO: 4472 - DNA, 33 bp, homo sapien
ttgcttcattttacttmtgtaaggaattgtaat

SEQ ID NO: 4473 - DNA, 33 bp, homo sapien
aagctgaggatgagagytgactgctgaactgag

SEQ ID NO: 4474 - DNA, 33 bp, homo sapien
acaaaatttgcacactrtattaccggaaagtga

SEQ ID NO: 4475 - DNA, 33 bp, homo sapien
atagaccttccatgtcstctctgggcgtgccat

SEQ ID NO: 4476 - DNA, 33 bp, homo sapien
caatcagagcacatcarcctagtaagaatctta

SEQ ID NO: 4477 - DNA, 33 bp, homo sapien
acttgggttatgaaaakacatcctaactgatgt

SEQ ID NO: 4478 - DNA, 33 bp, homo sapien
aaccctgtgaggtccarattattatttccatct

SEQ ID NO: 4479 - DNA, 33 bp, homo sapien
atcttcccacgatcagyttcaagaaccttcatg

SEQ ID NO: 4480 - DNA, 33 bp, homo sapien
ttcacttaactcctttyggatgtcacactgtca

SEQ ID NO: 4481 - DNA, 33 bp, homo sapien
acttgctctgtttctgragaaaatggagctcaa

SEQ ID NO: 4482 - DNA, 33 bp, homo sapien
gctgatgatacagaagyggaagcctgagcaaag

SEQ ID NO: 4483 - DNA, 33 bp, homo sapien
gattctgatgatagaargccatcacaggcttgt

SEQ ID NO: 4484 - DNA, 33 bp, homo sapien
taacagttttgtaaaartaggtcattcttaaat

SEQ ID NO: 4485 - DNA, 33 bp, homo sapien
ttagcacaagaacttargcggttcaaaaggcca

SEQ ID NO: 4486 - DNA, 33 bp, homo sapien
tgttgcaatccacattragataaggctgggaga

SEQ ID NO: 4487 - DNA, 33 bp, homo sapien
gagaaaatgtgccctarctcaggcagatagcaa

SEQ ID NO: 4488 - DNA, 33 bp, homo sapien
ctgactgagccatattmcctgagcccaatcact

SEQ ID NO: 4489 - DNA, 33 bp, homo sapien
agaagaatctggctttraatatctgccttacca

SEQ ID NO: 4490 - DNA, 33 bp, homo sapien
ttgatctatgttttatsatttatcagttgggaa

SEQ ID NO: 4491 - DNA, 33 bp, homo sapien
tatgactgcacagatcraaagtgtcgaactcac

SEQ ID NO: 4492 - DNA, 33 bp, homo sapien
cttctctcttgtagacwgtccagatcctgtgtt

SEQ ID NO: 4493 - DNA, 33 bp, homo sapien
tttttagtaaatatcaytggttctcccctttaa

SEQ ID NO: 4494 - DNA, 33 bp, homo sapien
cattggggcatgtcttyaatgctctggcagaca

SEQ ID NO: 4495 - DNA, 33 bp, homo sapien
ccaaagtgtaaggaccratgacacagagttgaa

SEQ ID NO: 4496 - DNA, 33 bp, homo sapien
aagcaacgtggagactsagaagcaagcgcagcg

SEQ ID NO: 4497 - DNA, 33 bp, homo sapien
tcactctgtcagtgttktgaaaggaaatacctg

SEQ ID NO: 4498 - DNA, 33 bp, homo sapien
agtcctccctgggctaycatttttctgtttcct

SEQ ID NO: 4499 - DNA, 33 bp, homo sapien
cccaaagttctctttgygtggcatttctcttct

SEQ ID NO: 4500 - DNA, 33 bp, homo sapien
aaacagccaggtatcayagagtgcttaagttct

SEQ ID NO: 4501 - DNA, 33 bp, homo sapien
aaggaaatagaaggtaygtggattagaaaggaa

SEQ ID NO: 4502 - DNA, 33 bp, homo sapien
agatgacatgtccatcmcacgatttattatatt

SEQ ID NO: 4503 - DNA, 33 bp, homo sapien
tttctatggcccaaccratgctttcttggtctc

SEQ ID NO: 4504 - DNA, 33 bp, homo sapien
agccattaaatttcctytgtagcttgtaaaggg

SEQ ID NO: 4505 - DNA, 33 bp, homo sapien
gattagatcatctccawgttctgaaatgctcaa

SEQ ID NO: 4506 - DNA, 33 bp, homo sapien
caacattccacattctkcacaccagtccaagtc

SEQ ID NO: 4507 - DNA, 33 bp, homo sapien
caaaaaattagcttacwagcaacttaaatatgg

SEQ ID NO: 4508 - DNA, 33 bp, homo sapien
tccacatgtcagtctcyctgatgattctatcac

SEQ ID NO: 4509 - DNA, 33 bp, homo sapien
aggcatagggctcactractgattgcaaacatc

SEQ ID NO: 4510 - DNA, 33 bp, homo sapien
tacttgtcccaaaccascagagtgccacagcga

SEQ ID NO: 4511 - DNA, 33 bp, homo sapien
atccgatatcagtcacrtgcaactaagtatgct

SEQ ID NO: 4512 - DNA, 33 bp, homo sapien
gcaacagcaatatcctstttcagaactagcgct

SEQ ID NO: 4513 - DNA, 33 bp, homo sapien
tttgggctacagctggrattcttgctatgctaa

SEQ ID NO: 4514 - DNA, 33 bp, homo sapien
ttgaaaagagttaatamattgcattcccttttc

SEQ ID NO: 4515 - DNA, 33 bp, homo sapien
tgcttgttacattttamgagtgacaagcaggtt

SEQ ID NO: 4516 - DNA, 33 bp, homo sapien
taatgatgatcctggaragaaaaaaaattcctc

SEQ ID NO: 4517 - DNA, 33 bp, homo sapien
tttaaaatttattctgyttaatgggtcgcttgt

SEQ ID NO: 4518 - DNA, 33 bp, homo sapien
atttgtattgctatcarcaacgtattatgccaa

SEQ ID NO: 4519 - DNA, 33 bp, homo sapien
tgcttttattctagtcrtgattgcagctgatta

SEQ ID NO: 4520 - DNA, 33 bp, homo sapien
attgccctaaaattatmctaatatccctgaaac

SEQ ID NO: 4521 - DNA, 33 bp, homo sapien
cattctcatcaacactycttattaactgctgtc

SEQ ID NO: 4522 - DNA, 33 bp, homo sapien
ttttggctccaggctgycatacactgaggttgg

SEQ ID NO: 4523 - DNA, 33 bp, homo sapien
tctaagttcttaatgtrctccaatgaaagatgg

SEQ ID NO: 4524 - DNA, 33 bp, homo sapien
tgttttctgaatttttstactgtggaatttttc

SEQ ID NO: 4525 - DNA, 33 bp, homo sapien
cggatatactaacatgygtcaaagaatacaatc

SEQ ID NO: 4526 - DNA, 33 bp, homo sapien
tggctgtttgatttggygatgacaatggcttca

SEQ ID NO: 4527 - DNA, 33 bp, homo sapien
tgtttcttgtgaaatargactgagcttttgtct

SEQ ID NO: 4528 - DNA, 33 bp, homo sapien
ttgccttgtatatgccrttttataacctttttt

SEQ ID NO: 4529 - DNA, 33 bp, homo sapien
ctgtagacctgcgttcrtgggcaactgtactct

SEQ ID NO: 4530 - DNA, 33 bp, homo sapien
atagttatgaatttgtycactttcactgatgtc

SEQ ID NO: 4531 - DNA, 33 bp, homo sapien
tctttatcatgcgtgayccctgaagtctgcttg

SEQ ID NO: 4532 - DNA, 33 bp, homo sapien
tcacatggtactgatgwtaaaaaaaaaaaaaat

SEQ ID NO: 4533 - DNA, 33 bp, homo sapien
aacagaaacttcatctyatattcacagagacac

SEQ ID NO: 4534 - DNA, 33 bp, homo sapien
ttctataaatcctagawataaaggaagcagtgt

SEQ ID NO: 4535 - DNA, 33 bp, homo sapien
ggtgatctgcaggagarctggtgcccttcaccc

SEQ ID NO: 4536 - DNA, 33 bp, homo sapien
acattttcaggtgttcrctagttcctatcctcc

SEQ ID NO: 4537 - DNA, 33 bp, homo sapien
aaccttggtatcattaktttctgtgatcacaaa

SEQ ID NO: 4538 - DNA, 33 bp, homo sapien
tcctctatcttgacttytactcttgagcagctc

SEQ ID NO: 4539 - DNA, 33 bp, homo sapien
tgttccaacaagcataytttccagagatcaaag

SEQ ID NO: 4540 - DNA, 33 bp, homo sapien
ctgtatggatggcatcrtttggttaaactgact

SEQ ID NO: 4541 - DNA, 33 bp, homo sapien
gaaaaggagaaaaaaamctgaagattcattacc

SEQ ID NO: 4542 - DNA, 33 bp, homo sapien
acggggccagggcttascttggtacctgagtaa

SEQ ID NO: 4543 - DNA, 33 bp, homo sapien
aaggcagcgctgtgacrtgggaagggccctgtc

SEQ ID NO: 4544 - DNA, 33 bp, homo sapien
ttagttttggtgctccrctctagtatatgttta

SEQ ID NO: 4545 - DNA, 33 bp, homo sapien
tcagggtctcacataawccaaaacttacacatt

SEQ ID NO: 4546 - DNA, 33 bp, homo sapien
ctactttcaggccacartgctaggaggaagcca

SEQ ID NO: 4547 - DNA, 33 bp, homo sapien
ggaaaacttggaacccrtgctgtggtatcaatt

SEQ ID NO: 4548 - DNA, 33 bp, homo sapien
tctcacattttacactyactgactgtgttgctt

SEQ ID NO: 4549 - DNA, 33 bp, homo sapien
atccaactctttgacaycaggttatttctagcc

SEQ ID NO: 4550 - DNA, 33 bp, homo sapien
gaaaccctttattgtgyaagactgccctgtgcc

SEQ ID NO: 4551 - DNA, 33 bp, homo sapien
tggtcctgggcattttytcgttggtaggctatt

SEQ ID NO: 4552 - DNA, 33 bp, homo sapien
acacattcctgagtcayagagtacaaacagaaa

SEQ ID NO: 4553 - DNA, 33 bp, homo sapien
gtctctactaaaaatcygaaacaattagccaga

SEQ ID NO: 4554 - DNA, 33 bp, homo sapien
ccaaagcataacaggtyggatgacatgggatag

SEQ ID NO: 4555 - DNA, 33 bp, homo sapien
tagattagatttattayctggatgattttacag

SEQ ID NO: 4556 - DNA, 33 bp, homo sapien
atggcagaagagacaakctgagaaaagaatctc

SEQ ID NO: 4557 - DNA, 33 bp, homo sapien
tggcttttcttggactstcaagtagtgtatact

SEQ ID NO: 4558 - DNA, 33 bp, homo sapien
ccctctccctacctgamcctacgaacaccacaa

SEQ ID NO: 4559 - DNA, 33 bp, homo sapien
caagcggagagacgaamattctaagaaagaacc

SEQ ID NO: 4560 - DNA, 33 bp, homo sapien
cagaacgttgtttctaygagtagagctcagaca

SEQ ID NO: 4561 - DNA, 33 bp, homo sapien
gtaccataatgagacargagagtaggatctgga

SEQ ID NO: 4562 - DNA, 33 bp, homo sapien
gtgctagtcctcacagkcacatagaaaattagg

SEQ ID NO: 4563 - DNA, 33 bp, homo sapien
gaacacaactttgaatsgttatataatatcttt

SEQ ID NO: 4564 - DNA, 33 bp, homo sapien
gttggggagggcagccytgtgcatttttggacg

SEQ ID NO: 4565 - DNA, 33 bp, homo sapien
attcaaacatattttcwatctctgattcataag

SEQ ID NO: 4566 - DNA, 33 bp, homo sapien
caacactatgtcctcartatccaattcacggcc

SEQ ID NO: 4567 - DNA, 33 bp, homo sapien
ttccttaaacgcctagrtacaataagtttctca

SEQ ID NO: 4568 - DNA, 33 bp, homo sapien
ccttatttgttgtatcrtttctatttttgagat

SEQ ID NO: 4569 - DNA, 33 bp, homo sapien
tttgcaatgtgttgtcrttacaggactgtaatt

SEQ ID NO: 4570 - DNA, 33 bp, homo sapien
acactgtgggcccttamtacttatggaatgaaa

SEQ ID NO: 4571 - DNA, 33 bp, homo sapien
aaggcttgagtcaaatmaccctgattctcaggg

SEQ ID NO: 4572 - DNA, 33 bp, homo sapien
cctgcagcaaaaatcayttgggcatcatccttg

SEQ ID NO: 4573 - DNA, 33 bp, homo sapien
ttcatcctcctttgacsttctatttgggccgat

SEQ ID NO: 4574 - DNA, 33 bp, homo sapien
gaaaatgcacagaaacrgggcagcacaagaaca

SEQ ID NO: 4575 - DNA, 33 bp, homo sapien
tgggaggccgagatggktctatcaatggaggcc

SEQ ID NO: 4576 - DNA, 33 bp, homo sapien
gcgttaatgagtggccrgtgttattaactatgt

SEQ ID NO: 4577 - DNA, 33 bp, homo sapien
agtggcttatttcctcwtctgttttggtatttt

SEQ ID NO: 4578 - DNA, 33 bp, homo sapien
aagatgactgaatcatrgggtagttcttaatgg

SEQ ID NO: 4579 - DNA, 33 bp, homo sapien
agttgaagaggatgggmcttttcagttgaattg

SEQ ID NO: 4580 - DNA, 33 bp, homo sapien
ttacattacaacatacrctaaatgtaactggaa

SEQ ID NO: 4581 - DNA, 33 bp, homo sapien
ctgaatccctttatccwgcttcctcttcctgct

SEQ ID NO: 4582 - DNA, 33 bp, homo sapien
gcaagccaaagccatcrtgcctagcagaggagc

SEQ ID NO: 4583 - DNA, 33 bp, homo sapien
ggaagaaataagtccarattccccatcagttca

SEQ ID NO: 4584 - DNA, 33 bp, homo sapien
atgtaaatactagtagwcattcataaccaaatc

SEQ ID NO: 4585 - DNA, 33 bp, homo sapien
ctttgaaaagattttcsgacatgataattagct

SEQ ID NO: 4586 - DNA, 33 bp, homo sapien
aacaagcaaagcctcargacatttgcctttcac

SEQ ID NO: 4587 - DNA, 33 bp, homo sapien
ttagggcgggtgatatytgagtgtggcctgaaa

SEQ ID NO: 4588 - DNA, 33 bp, homo sapien
catagcaagcttcacawctttctccgactctga

SEQ ID NO: 4589 - DNA, 33 bp, homo sapien
tctatgcgtacaagcckctgtgccgcccagccc

SEQ ID NO: 4590 - DNA, 33 bp, homo sapien
gttctcccattatccaygtttatcctcccagcc

SEQ ID NO: 4591 - DNA, 33 bp, homo sapien
ggtctcctgactccaawtataagtctaaccaat

SEQ ID NO: 4592 - DNA, 33 bp, homo sapien
agccagaggtaaagaartcgtaagtgttcaaaa

SEQ ID NO: 4593 - DNA, 33 bp, homo sapien
tcattgagtaacttctrtgtgccaggtacctta

SEQ ID NO: 4594 - DNA, 33 bp, homo sapien
tcgaatcattgacattrcatatgcccagtagtg

SEQ ID NO: 4595 - DNA, 33 bp, homo sapien
ccaggactaaaagaacmgctcagccaactataa

SEQ ID NO: 4596 - DNA, 33 bp, homo sapien
gacctgggagctccaaytcttccctttatttta

SEQ ID NO: 4597 - DNA, 33 bp, homo sapien
tgactactaaaatcagscttttttcatttctgc

SEQ ID NO: 4598 - DNA, 33 bp, homo sapien
ataaggtagtgtttgcyttcgttacatagaaaa

SEQ ID NO: 4599 - DNA, 33 bp, homo sapien
tgctactgtgttttgcscagagttaggacaatt

SEQ ID NO: 4600 - DNA, 33 bp, homo sapien
tctccagatccttaatrtcatcacatctgtgaa

SEQ ID NO: 4601 - DNA, 33 bp, homo sapien
ttataggggaaagtctrtgggatcaaagcattt

SEQ ID NO: 4602 - DNA, 33 bp, homo sapien
caggggtaaaagtcagkcaggttttcttgcagt

SEQ ID NO: 4603 - DNA, 33 bp, homo sapien
gctctttgccatgggawtctctttgcctttgta

SEQ ID NO: 4604 - DNA, 33 bp, homo sapien
tctctctcatcccagtrgaatatgtagcaattc

SEQ ID NO: 4605 - DNA, 33 bp, homo sapien
agtaaagacacttttcktaaggaatgagacact

SEQ ID NO: 4606 - DNA, 33 bp, homo sapien
attagctataaatataytgacttctctaatgtt

SEQ ID NO: 4607 - DNA, 33 bp, homo sapien
aaagtgcatagtgtatyggtattgtgttaataa

SEQ ID NO: 4608 - DNA, 33 bp, homo sapien
accaatttcttgaaatraatagcaagagcaaat

SEQ ID NO: 4609 - DNA, 33 bp, homo sapien
ctctacctttctcttayaaggacactgtgattg

SEQ ID NO: 4610 - DNA, 33 bp, homo sapien
gggcctctcagctgccrcttaatgactttacct

SEQ ID NO: 4611 - DNA, 33 bp, homo sapien
cagagactgggatacaraaaacaatgaagaaag

SEQ ID NO: 4612 - DNA, 33 bp, homo sapien
tctatttgaaaatttcmctattttgtcatcatg

SEQ ID NO: 4613 - DNA, 33 bp, homo sapien
gcagttcttcaccagcyagacatcgtcacctca

SEQ ID NO: 4614 - DNA, 33 bp, homo sapien
ccacatgaagattgagraaggagatggatgtgt

SEQ ID NO: 4615 - DNA, 33 bp, homo sapien
acccagtgagtagcttrgtatcaggtatccaag

SEQ ID NO: 4616 - DNA, 33 bp, homo sapien
atgcccggctgcatacrtagcagtctgttcttt

SEQ ID NO: 4617 - DNA, 33 bp, homo sapien
agaagtgaacttagttyggagctaccttgagta

SEQ ID NO: 4618 - DNA, 33 bp, homo sapien
cgcagtcactgcacacrtgttctccaagaagca

SEQ ID NO: 4619 - DNA, 33 bp, homo sapien
ggctcatgtggatggcygaggtgcccacaggtg

SEQ ID NO: 4620 - DNA, 33 bp, homo sapien
gagctgccagtccctcwggaggaactcaagttg

SEQ ID NO: 4621 - DNA, 33 bp, homo sapien
gataaaagataaacagytgaagaatctgggtga

SEQ ID NO: 4622 - DNA, 33 bp, homo sapien
accctacaatgtctacrgatgccagaactgtgg

SEQ ID NO: 4623 - DNA, 33 bp, homo sapien
ttttacattcatcatayaaaagaatcatacagt

SEQ ID NO: 4624 - DNA, 33 bp, homo sapien
ggcaactatcttgatcycctgaaaaaaagagtc

SEQ ID NO: 4625 - DNA, 33 bp, homo sapien
acttctgagcctctatrttttcatttctaagct

SEQ ID NO: 4626 - DNA, 33 bp, homo sapien
tgagggtagctgcactraacaatggattttcaa

SEQ ID NO: 4627 - DNA, 33 bp, homo sapien
ggtttctaatagtactycatcatagagttatta

SEQ ID NO: 4628 - DNA, 33 bp, homo sapien
aaattcatatgtactcrttgcaacaaatgcaga

SEQ ID NO: 4629 - DNA, 33 bp, homo sapien
atgaccttataagtgcrgtcttccaggggacta

SEQ ID NO: 4630 - DNA, 33 bp, homo sapien
acgatttaaggaccggygttgctttctgactag

SEQ ID NO: 4631 - DNA, 33 bp, homo sapien
tggtgatggggttgccwgacacctagtcctggg

SEQ ID NO: 4632 - DNA, 33 bp, homo sapien
cctaagcactgcaaatsgcatcagactgagggc

SEQ ID NO: 4633 - DNA, 33 bp, homo sapien
atgttgatacttttatktaattctctgttttta

SEQ ID NO: 4634 - DNA, 33 bp, homo sapien
ggatgcgatgaaatttstgatttgtaaatgttc

SEQ ID NO: 4635 - DNA, 33 bp, homo sapien
aatgattttaacagatygaatgggagttcttac

SEQ ID NO: 4636 - DNA, 33 bp, homo sapien
agctggtctcaaagccrtaattgatatttatca

SEQ ID NO: 4637 - DNA, 33 bp, homo sapien
gggagagaaagtctgcrtacatatagcctcctc

SEQ ID NO: 4638 - DNA, 33 bp, homo sapien
tgtcatacttttatacrtgaaatgggtcctgtc

SEQ ID NO: 4639 - DNA, 33 bp, homo sapien
ttaatgtgtttggcttyaataattccattttat

SEQ ID NO: 4640 - DNA, 33 bp, homo sapien
ccacctaacctaaaatrgagttccccacaggtc

SEQ ID NO: 4641 - DNA, 33 bp, homo sapien
ggtgaacagagattagwtcaccaatattagaat

SEQ ID NO: 4642 - DNA, 33 bp, homo sapien
agtaacgtttgcatggracagtctcaaacttca

SEQ ID NO: 4643 - DNA, 33 bp, homo sapien
gccacctgtggcacttyagcgactattcaatat

SEQ ID NO: 4644 - DNA, 33 bp, homo sapien
aaagagcaagtatgatmcaatgcctttgcagag

SEQ ID NO: 4645 - DNA, 33 bp, homo sapien
ctgtttcccacgaaacratgacttctcttctca

SEQ ID NO: 4646 - DNA, 33 bp, homo sapien
ggatccagtggctctcytacctccttttccttc

SEQ ID NO: 4647 - DNA, 33 bp, homo sapien
ctccagaagtttgcatragtctgtccattcagt

SEQ ID NO: 4648 - DNA, 33 bp, homo sapien
ttatgcttgaattcttyaaaataagtacatatc

SEQ ID NO: 4649 - DNA, 33 bp, homo sapien
gagcctactgcacttcyaaatcttgaacaattg

SEQ ID NO: 4650 - DNA, 33 bp, homo sapien
atataaaaatataaaaygtgatatgtaagtgta

SEQ ID NO: 4651 - DNA, 33 bp, homo sapien
tttccttgaccccattrttgatgtcttgggaga

SEQ ID NO: 4652 - DNA, 33 bp, homo sapien
ttggagtcactcattcmgggttagaatcatggt

SEQ ID NO: 4653 - DNA, 33 bp, homo sapien
aaggtggctatgtagasccggttcgcagtcaag

SEQ ID NO: 4654 - DNA, 33 bp, homo sapien
gatgtcattatcatgcyagctaaaattggccag

SEQ ID NO: 4655 - DNA, 33 bp, homo sapien
ttttaggtttttgttasagcagtgccccacttc

SEQ ID NO: 4656 - DNA, 33 bp, homo sapien
cccggattccatttctkctgtatatccattggc

SEQ ID NO: 4657 - DNA, 33 bp, homo sapien
tctgtggaattttaaamactgcctggtacatga

SEQ ID NO: 4658 - DNA, 33 bp, homo sapien
acaaaataagttttttwaaatgatcaggaagtg

SEQ ID NO: 4659 - DNA, 33 bp, homo sapien
gaaactatggaaactartatctttgaacatctc

SEQ ID NO: 4660 - DNA, 33 bp, homo sapien
tattcttttccattgawtccaggaatatatcta

SEQ ID NO: 4661 - DNA, 33 bp, homo sapien
gtagcactgagttattyttgagaatcctatttt

SEQ ID NO: 4662 - DNA, 33 bp, homo sapien
gctttgcattcaatatmgccatttatgaaaagt

SEQ ID NO: 4663 - DNA, 33 bp, homo sapien
tggaagacggctacgtracggaaacccagaggg

SEQ ID NO: 4664 - DNA, 33 bp, homo sapien
ttattcccttatcatamatgctagaagactgga

SEQ ID NO: 4665 - DNA, 33 bp, homo sapien
aagcaaaatgatctttrtgtgactcttttgata

SEQ ID NO: 4666 - DNA, 33 bp, homo sapien
tgaaattgaatgttcartcactaacaaaggaat

SEQ ID NO: 4667 - DNA, 33 bp, homo sapien
agaacacttagaagagrccatatatgatttaat

SEQ ID NO: 4668 - DNA, 33 bp, homo sapien
ttcaggaatgggaatawtgtgatgaaaacaagg

SEQ ID NO: 4669 - DNA, 33 bp, homo sapien
taaagtcacatgaactraaaagcattacagttt

SEQ ID NO: 4670 - DNA, 33 bp, homo sapien
cagcctgcaaagcttcrcctctagggaatctat

SEQ ID NO: 4671 - DNA, 33 bp, homo sapien
aatgcctgtaaattcayggctatggtaaaaggg

SEQ ID NO: 4672 - DNA, 33 bp, homo sapien
gatactgacatcaagasctaaggtaatttatct

SEQ ID NO: 4673 - DNA, 33 bp, homo sapien
aagagtgtcttttgctkgttaatgagatgactg

SEQ ID NO: 4674 - DNA, 33 bp, homo sapien
agggataaggacatgtraaggaagttggaacac

SEQ ID NO: 4675 - DNA, 33 bp, homo sapien
caatgtcgctggacaaygaaacactgcagctgg

SEQ ID NO: 4676 - DNA, 33 bp, homo sapien
acaatacattaaaagaycattcatatgcaaatc

SEQ ID NO: 4677 - DNA, 33 bp, homo sapien
atacctcgtgccaatcyatcatgtcaggcataa

SEQ ID NO: 4678 - DNA, 33 bp, homo sapien
ttaaagtgttactattyggccttttacagaaaa

SEQ ID NO: 4679 - DNA, 33 bp, homo sapien
atcttcttggtccatawgttttaactaacagat

SEQ ID NO: 4680 - DNA, 33 bp, homo sapien
gttattaattctagtcrttatccatcaagacac

SEQ ID NO: 4681 - DNA, 33 bp, homo sapien
gcagcttgccttttcaktttcataacagtgttt

SEQ ID NO: 4682 - DNA, 33 bp, homo sapien
caaaagcatgcctaggracactagcacctaact

SEQ ID NO: 4683 - DNA, 33 bp, homo sapien
ggtgaccaggctttccrcattttctaccatttt

SEQ ID NO: 4684 - DNA, 33 bp, homo sapien
cttcactgtattcacayacttcttttggatgac

SEQ ID NO: 4685 - DNA, 33 bp, homo sapien
gaatggtttgtatctgkttattaaaagttactc

SEQ ID NO: 4686 - DNA, 33 bp, homo sapien
atacatccatcctggcrttaaaaagtagaaaag

SEQ ID NO: 4687 - DNA, 33 bp, homo sapien
tgaatcctgtgttaccrtaaaggacaactgatt

SEQ ID NO: 4688 - DNA, 33 bp, homo sapien
ttctgggtagaagtatwacttgaaagaggcagc

SEQ ID NO: 4689 - DNA, 33 bp, homo sapien
aaaacagataaaccatrgagaaaattaataaag

SEQ ID NO: 4690 - DNA, 33 bp, homo sapien
tttagagagaagaacargaaagtgaatttgtaa

SEQ ID NO: 4691 - DNA, 33 bp, homo sapien
gccacttaccatgaatrgagcttgcagggctgg

SEQ ID NO: 4692 - DNA, 33 bp, homo sapien
atcctatagagcatttsaggaatggataatctg

SEQ ID NO: 4693 - DNA, 33 bp, homo sapien
agacagaggcttcaaaygactggtttataaccc

SEQ ID NO: 4694 - DNA, 33 bp, homo sapien
ctcttctaattggagcytcttaaattgaaggag

SEQ ID NO: 4695 - DNA, 33 bp, homo sapien
aaccatattcactttcyggtcttgttatattta

SEQ ID NO: 4696 - DNA, 33 bp, homo sapien
tcctctgtgcctaagcsactatgaaatagttgc

SEQ ID NO: 4697 - DNA, 33 bp, homo sapien
caaatagcagcttaccragaccaaaaggggcta

SEQ ID NO: 4698 - DNA, 33 bp, homo sapien
ttcaaacgtattctcayctacagaaaagaggat

SEQ ID NO: 4699 - DNA, 33 bp, homo sapien
tcttacaaaattatagkcctgatttctccttac

SEQ ID NO: 4700 - DNA, 33 bp, homo sapien
attctgaaagtgtaaasacgagtcccaggccct

SEQ ID NO: 4701 - DNA, 33 bp, homo sapien
ttttgtctactacatcrctgcagctgcaaatgt

SEQ ID NO: 4702 - DNA, 33 bp, homo sapien
aatacgaagcaaaaacsttctctcatttgtgca

SEQ ID NO: 4703 - DNA, 33 bp, homo sapien
tacaacatgataaaagsttgcttatttaagatg

SEQ ID NO: 4704 - DNA, 33 bp, homo sapien
taaatctaccaaacagwatttgaagtcttttat

SEQ ID NO: 4705 - DNA, 33 bp, homo sapien
gcttagtctgcatcatraacccaaattcctccc

SEQ ID NO: 4706 - DNA, 33 bp, homo sapien
taacacaccacataccrggatgttttgggtaac

SEQ ID NO: 4707 - DNA, 33 bp, homo sapien
gcctgctttggaaatarggtgtacactgtttag

SEQ ID NO: 4708 - DNA, 33 bp, homo sapien
gtttcctctctgaaaaygtccatggataattta

SEQ ID NO: 4709 - DNA, 33 bp, homo sapien
gcaccacccagtaccgrctgatgaagtggtcta

SEQ ID NO: 4710 - DNA, 33 bp, homo sapien
tctgtgctaggccctgragaggcaaagacacct

SEQ ID NO: 4711 - DNA, 33 bp, homo sapien
accaaactatgcccaayatgttttcatttcatt

SEQ ID NO: 4712 - DNA, 33 bp, homo sapien
gaaactgtgttcagaamcctctcacatgcatgt

SEQ ID NO: 4713 - DNA, 33 bp, homo sapien
tcctcatctccttcaaygagcttgttgtccatc

SEQ ID NO: 4714 - DNA, 33 bp, homo sapien
tcatccttcactgtgcrtatgtgagaggatttc

SEQ ID NO: 4715 - DNA, 33 bp, homo sapien
gcacatgtagaggcctwctcctcacagcacagt

SEQ ID NO: 4716 - DNA, 33 bp, homo sapien
attccatttagtctacrtaatacatccctccct

SEQ ID NO: 4717 - DNA, 33 bp, homo sapien
aaacaccataaaaaatytaccagttagtggata

SEQ ID NO: 4718 - DNA, 33 bp, homo sapien
gaaagtagttgggtaargaaactgccaagcctt

SEQ ID NO: 4719 - DNA, 33 bp, homo sapien
acaacccctgattcctmtaagatttttgtgtcc

SEQ ID NO: 4720 - DNA, 33 bp, homo sapien
aagtttgcttacctctsctttacatcattaact

SEQ ID NO: 4721 - DNA, 33 bp, homo sapien
cctgcttccctttttcktcagattaattcacaa

SEQ ID NO: 4722 - DNA, 33 bp, homo sapien
atagatctcacacataygtagttcacaatagag

SEQ ID NO: 4723 - DNA, 33 bp, homo sapien
ctattaggccaacatgmgtgcactgatgcctct

SEQ ID NO: 4724 - DNA, 33 bp, homo sapien
gcaaatatggcctaagraaatgcagttaaaatg

SEQ ID NO: 4725 - DNA, 33 bp, homo sapien
ctaactctaagtacacmctggaaaattacagca

SEQ ID NO: 4726 - DNA, 33 bp, homo sapien
aagagttcagaatatgytccttatccaaggtcc

SEQ ID NO: 4727 - DNA, 33 bp, homo sapien
agcatacctattgcacrcagtagctttgagcga

SEQ ID NO: 4728 - DNA, 33 bp, homo sapien
gcaaatactacacatgmccgctatactattttt

SEQ ID NO: 4729 - DNA, 33 bp, homo sapien
cattggtatatgtttgsaatgagcatgctttct

SEQ ID NO: 4730 - DNA, 33 bp, homo sapien
tatctcatacttatctyggtctgagtcagtatc

SEQ ID NO: 4731 - DNA, 33 bp, homo sapien
ctaaacttctccagatmgcaggatagctgaaca

SEQ ID NO: 4732 - DNA, 33 bp, homo sapien
ccaagctccttttactmtgtccaaagtcttttg

SEQ ID NO: 4733 - DNA, 33 bp, homo sapien
gcttgtggctccatcckccatatttaaagctca

SEQ ID NO: 4734 - DNA, 33 bp, homo sapien
ttaataaagctaaaatrtgtctcattccaaaca

SEQ ID NO: 4735 - DNA, 33 bp, homo sapien
atggcaagggtagtcgycttctgatgttgtcag

SEQ ID NO: 4736 - DNA, 33 bp, homo sapien
acctgcggttaggaagkttgtcaaaatgagacg

SEQ ID NO: 4737 - DNA, 33 bp, homo sapien
acaccccacagcacagkgtcttgtattcaaaac

SEQ ID NO: 4738 - DNA, 33 bp, homo sapien
aactaggtcaagcaatrttatcctcttttatgt

SEQ ID NO: 4739 - DNA, 33 bp, homo sapien
ggctttggagttgcacmtgctattcattataaa

SEQ ID NO: 4740 - DNA, 33 bp, homo sapien
ttaaacaacagtctctratttttttatttttat

SEQ ID NO: 4741 - DNA, 33 bp, homo sapien
agaaatctataatgaayggttaatacttttaaa

SEQ ID NO: 4742 - DNA, 33 bp, homo sapien
gaaaatgtgtcagcagrgccagctcatcaactg

SEQ ID NO: 4743 - DNA, 33 bp, homo sapien
cctcctcttaatcaaaytgacagaaactaaagc

SEQ ID NO: 4744 - DNA, 33 bp, homo sapien
caacctaatacagccayctgctaaaggaggaaa

SEQ ID NO: 4745 - DNA, 33 bp, homo sapien
tcctgggtcaggctgcrtgaatcactttcaaga

SEQ ID NO: 4746 - DNA, 33 bp, homo sapien
taaaagtcttacatgcyttcttaaaacacaggg

SEQ ID NO: 4747 - DNA, 33 bp, homo sapien
gttactgtttataagaygcctacaataaagaac

SEQ ID NO: 4748 - DNA, 33 bp, homo sapien
gcatcactgttttattygtccagaaagactaaa

SEQ ID NO: 4749 - DNA, 33 bp, homo sapien
ttagtatctattcaagscttttttattttgggg

SEQ ID NO: 4750 - DNA, 33 bp, homo sapien
aaagagagcttatctaytgaatgacctcagata

SEQ ID NO: 4751 - DNA, 33 bp, homo sapien
ctgggtgacaatatgargatttttaaggcttct

SEQ ID NO: 4752 - DNA, 33 bp, homo sapien
cttcgatccaatcgccytaaagaatgatttttt

SEQ ID NO: 4753 - DNA, 33 bp, homo sapien
cagatgtctgagaactycagaagagcctatcat

SEQ ID NO: 4754 - DNA, 33 bp, homo sapien
tttactgcctcaaggargatgtaagtaatttac

SEQ ID NO: 4755 - DNA, 33 bp, homo sapien
atgacaggagaggagayggcgcaggatcactca

SEQ ID NO: 4756 - DNA, 33 bp, homo sapien
cagtggagtagagcacktagcagtatcctgggg

SEQ ID NO: 4757 - DNA, 33 bp, homo sapien
cctttaccagcattacygagccactagtgtatt

SEQ ID NO: 4758 - DNA, 33 bp, homo sapien
atgcctttattcagatkatcctacatatgacct

SEQ ID NO: 4759 - DNA, 33 bp, homo sapien
tttaagtaacacaaagwtcaatggatgtttctc

SEQ ID NO: 4760 - DNA, 33 bp, homo sapien
tactatttagcccagaytattcatatactacat

SEQ ID NO: 4761 - DNA, 33 bp, homo sapien
ggtgattcacacttggktctccttccaaagccc

SEQ ID NO: 4762 - DNA, 33 bp, homo sapien
tctgttcccttcaatgkattccaggctgcactt

SEQ ID NO: 4763 - DNA, 33 bp, homo sapien
gatgctgacttaaatgwcacccttgttatttat

SEQ ID NO: 4764 - DNA, 33 bp, homo sapien
attacacgttcttcctsttggaccccaagccca

SEQ ID NO: 4765 - DNA, 33 bp, homo sapien
ttttcatgattaaattyagctctggtgtagttt

SEQ ID NO: 4766 - DNA, 33 bp, homo sapien
gaaaaaaataatgttayggaagcacagggaaat

SEQ ID NO: 4767 - DNA, 33 bp, homo sapien
ctcccttgtgaaaaaayattaagttaccagctg

SEQ ID NO: 4768 - DNA, 33 bp, homo sapien
cccattttaacactcaycatagctcagaatgtt

SEQ ID NO: 4769 - DNA, 33 bp, homo sapien
gccaaccctagggtatrgttcttgctcttatgg

SEQ ID NO: 4770 - DNA, 33 bp, homo sapien
gccttattgttgttgayacggggaaaatttcag

SEQ ID NO: 4771 - DNA, 33 bp, homo sapien
tctattttgtgggtaayagtacctgctatactg

SEQ ID NO: 4772 - DNA, 33 bp, homo sapien
ctgtatgaggtcgcagscttctctgtcttttct

SEQ ID NO: 4773 - DNA, 33 bp, homo sapien
tgagcccatcagtgacmaagtacaaactgttgg

SEQ ID NO: 4774 - DNA, 33 bp, homo sapien
gagagatttgaagcttsttttgttcagagtttt

SEQ ID NO: 4775 - DNA, 33 bp, homo sapien
atggatcaatgacatartattcccattcatgtg

SEQ ID NO: 4776 - DNA, 33 bp, homo sapien
gcttttcatcaattagktttttttgtttatagt

SEQ ID NO: 4777 - DNA, 33 bp, homo sapien
tgtgttgaaggaataaytacttgttcattttgt

SEQ ID NO: 4778 - DNA, 33 bp, homo sapien
atttaaaaattagtagygtttctacatgctaac

SEQ ID NO: 4779 - DNA, 33 bp, homo sapien
tcctgcttaccgcggtsgtttttagatccgtct

SEQ ID NO: 4780 - DNA, 33 bp, homo sapien
gtttactccactaacartcttgctccgacatgt

SEQ ID NO: 4781 - DNA, 33 bp, homo sapien
gaggctctgcaacatawccattcagaatatggg

SEQ ID NO: 4782 - DNA, 33 bp, homo sapien
aggagggatgaagagtkgctagagtttcttctt

SEQ ID NO: 4783 - DNA, 33 bp, homo sapien
acatatgagggaaaatyagccatgaaaaattct

SEQ ID NO: 4784 - DNA, 33 bp, homo sapien
aacatgttgacaaatcmaaattagtatttctta

SEQ ID NO: 4785 - DNA, 33 bp, homo sapien
ggggtgattatagggarcaattaagaagaaggc

SEQ ID NO: 4786 - DNA, 33 bp, homo sapien
ttctgctatgtccactrgaagaagtattcccct

SEQ ID NO: 4787 - DNA, 33 bp, homo sapien
tctattaatattgaggsctttttatctgaggtt

SEQ ID NO: 4788 - DNA, 33 bp, homo sapien
gaaccaaaacctcatgwtggcctgcagaggcaa

SEQ ID NO: 4789 - DNA, 33 bp, homo sapien
gaagctgagaagcattyggctgattctccccct

SEQ ID NO: 4790 - DNA, 33 bp, homo sapien
catacaacacatatgamtacacaacagacagaa

SEQ ID NO: 4791 - DNA, 33 bp, homo sapien
attttaatgtctctctstgttccttctattagt

SEQ ID NO: 4792 - DNA, 33 bp, homo sapien
aggtggttcagcacagmaagaaagacttcattt

SEQ ID NO: 4793 - DNA, 33 bp, homo sapien
attaaagtgtgaattcygatttgaggatttata

SEQ ID NO: 4794 - DNA, 33 bp, homo sapien
acttcatctctgtaagyctgttttgctcatcca

SEQ ID NO: 4795 - DNA, 33 bp, homo sapien
ctcccgtgtcacacaarttcatctttgcctatc

SEQ ID NO: 4796 - DNA, 33 bp, homo sapien
tcggaataacactactkctattcactttttgct

SEQ ID NO: 4797 - DNA, 33 bp, homo sapien
agtgattgagtattcayctgtaagatagtgaca

SEQ ID NO: 4798 - DNA, 33 bp, homo sapien
tcagcaactctaccaarcaccaacttacatagc

SEQ ID NO: 4799 - DNA, 33 bp, homo sapien
tcaattactagcattaygcattttgatgctcaa

SEQ ID NO: 4800 - DNA, 33 bp, homo sapien
tcaaagaaaattcaccrtatagttgaaggatgg

SEQ ID NO: 4801 - DNA, 33 bp, homo sapien
cagctgtcacatatttycattttgtactggaga

SEQ ID NO: 4802 - DNA, 33 bp, homo sapien
tggggcctggacattgyattgtttaaaagcttc

SEQ ID NO: 4803 - DNA, 33 bp, homo sapien
atttaaagaaaaaaggrcagtgagtagtataca

SEQ ID NO: 4804 - DNA, 33 bp, homo sapien
caagttctactagttcrtcttctataagatcag

SEQ ID NO: 4805 - DNA, 33 bp, homo sapien
ataatgaccatttctgkaaattcatagaattcc

SEQ ID NO: 4806 - DNA, 33 bp, homo sapien
tcatgattcatcagcarcctaagagacagcatg

SEQ ID NO: 4807 - DNA, 33 bp, homo sapien
cttgcaaaactatgagsgtccaggcagctagca

SEQ ID NO: 4808 - DNA, 33 bp, homo sapien
gtacacaagctggtttyttacttaaatactgct

SEQ ID NO: 4809 - DNA, 33 bp, homo sapien
tcttatgagctgtaaarcaaaagcatcaggtaa

SEQ ID NO: 4810 - DNA, 33 bp, homo sapien
atttattttagcagtaygaaacagactaataca

SEQ ID NO: 4811 - DNA, 33 bp, homo sapien
tagtgtgtgttatttcsatcatttttctccttt

SEQ ID NO: 4812 - DNA, 33 bp, homo sapien
gaattaatctatgaatragaaagacccaaggtc

SEQ ID NO: 4813 - DNA, 33 bp, homo sapien
tgattgtaacaaggatkatgtaattttgtatag

SEQ ID NO: 4814 - DNA, 33 bp, homo sapien
catcatctgcatttcastttaatgaatctctat

SEQ ID NO: 4815 - DNA, 33 bp, homo sapien
acagaactgggatccarggaccgtacattcagc

SEQ ID NO: 4816 - DNA, 33 bp, homo sapien
cttgtgccttcttagtrtcgtaactgtttctgt

SEQ ID NO: 4817 - DNA, 33 bp, homo sapien
ggtccacatttctttcrctaagttatcacatgg

SEQ ID NO: 4818 - DNA, 33 bp, homo sapien
aaaagcacaagcacaaktcactgttgtaagcat

SEQ ID NO: 4819 - DNA, 33 bp, homo sapien
agagggagcgtgctctsgaattgaatgccatga

SEQ ID NO: 4820 - DNA, 33 bp, homo sapien
aagctttcttactacartgtaaatgactggcct

SEQ ID NO: 4821 - DNA, 33 bp, homo sapien
caggaagtgtgtcatasgctgccaagtttgatc

SEQ ID NO: 4822 - DNA, 33 bp, homo sapien
gcaccatataaaacagraactgttggagagcat

SEQ ID NO: 4823 - DNA, 33 bp, homo sapien
atctgatgaataattcytaaaatacgcaaatat

SEQ ID NO: 4824 - DNA, 33 bp, homo sapien
tagtttttctgtcaagyagatggtgagggtaac

SEQ ID NO: 4825 - DNA, 33 bp, homo sapien
catgaaatgcttagaawcctgagaactgcaggg

SEQ ID NO: 4826 - DNA, 33 bp, homo sapien
gtgtattggcagggacsaaaataacatacagtg

SEQ ID NO: 4827 - DNA, 33 bp, homo sapien
tgcatattaaaagatargccagtacatctctga

SEQ ID NO: 4828 - DNA, 33 bp, homo sapien
caacccatcaacaaatsctatcaattttacctc

SEQ ID NO: 4829 - DNA, 33 bp, homo sapien
aggagataagagtgttycttctcaaatcatctc

SEQ ID NO: 4830 - DNA, 33 bp, homo sapien
gtagtttctatatagaraaagaagttggatgag

SEQ ID NO: 4831 - DNA, 33 bp, homo sapien
atgttgtccaaaacaamcaaatattgcatcctc

SEQ ID NO: 4832 - DNA, 33 bp, homo sapien
aaccccagggcctcccracatgtggtcttttct

SEQ ID NO: 4833 - DNA, 33 bp, homo sapien
gcccccagtcagtcttsctccctggtgagactt

SEQ ID NO: 4834 - DNA, 33 bp, homo sapien
aagctgaggcactgaawacctaaatttcctgcc

SEQ ID NO: 4835 - DNA, 33 bp, homo sapien
ttatctgttgctatgasagaggtattaaaatct

SEQ ID NO: 4836 - DNA, 33 bp, homo sapien
gaaaaacaaatggaaamaaagacactttgaaat

SEQ ID NO: 4837 - DNA, 33 bp, homo sapien
caaggaagttcttccargccaccaccgaagttc

SEQ ID NO: 4838 - DNA, 33 bp, homo sapien
ggactgcccaggtttaragtttctcaggcttgt

SEQ ID NO: 4839 - DNA, 33 bp, homo sapien
ttccaagaattactggrctgtgcattcctctcc

SEQ ID NO: 4840 - DNA, 33 bp, homo sapien
cctgtcagcttggcagraaatgtaatgcttcta

SEQ ID NO: 4841 - DNA, 33 bp, homo sapien
tgcctcagatgtttgtytgctctttgttgggtg

SEQ ID NO: 4842 - DNA, 33 bp, homo sapien
atgacagcatccaccayggaaatcgtattgcag

SEQ ID NO: 4843 - DNA, 33 bp, homo sapien
aatatccttttagagtraagcaggtaaacttcg

SEQ ID NO: 4844 - DNA, 33 bp, homo sapien
gaacaatgggaacaagygagacagagcctgtct

SEQ ID NO: 4845 - DNA, 33 bp, homo sapien
cctgcgtttagggaaaycacatttacccacagg

SEQ ID NO: 4846 - DNA, 33 bp, homo sapien
ttccaaaaagagagccmgaaaccagtatgcagt

SEQ ID NO: 4847 - DNA, 33 bp, homo sapien
aacagagcataaaaaawtggtgttctccatgtg

SEQ ID NO: 4848 - DNA, 33 bp, homo sapien
ctaaagctggaaaatgyaactggcatactgaag

SEQ ID NO: 4849 - DNA, 33 bp, homo sapien
tcaatgagcaacagacwtttctgcaacaggcag

SEQ ID NO: 4850 - DNA, 33 bp, homo sapien
agttctggagtacctgmatcatacaattacaac

SEQ ID NO: 4851 - DNA, 33 bp, homo sapien
tgtcttcttgcaccaamgtttgattgatttgag

SEQ ID NO: 4852 - DNA, 33 bp, homo sapien
gtggctgtacaagtcayctatgaaactgttctc

SEQ ID NO: 4853 - DNA, 33 bp, homo sapien
tgtttctctgcctttcrccttcttagtttctct

SEQ ID NO: 4854 - DNA, 33 bp, homo sapien
tcctcaacagtagccaytagatatcagccctcc

SEQ ID NO: 4855 - DNA, 33 bp, homo sapien
acagatcccttagaacrgactagaaaatgtatt

SEQ ID NO: 4856 - DNA, 33 bp, homo sapien
cctccataaataccttrtatcattctccagtcc

SEQ ID NO: 4857 - DNA, 33 bp, homo sapien
tctgacatacaaactakaagatgataaatttgc

SEQ ID NO: 4858 - DNA, 33 bp, homo sapien
tcatgtggaaatacaawagagcctaaataggta

SEQ ID NO: 4859 - DNA, 33 bp, homo sapien
gttttggatactttttycagttgattctcttat

SEQ ID NO: 4860 - DNA, 33 bp, homo sapien
gaggagttgggaacacrtgatgagctctgagga

SEQ ID NO: 4861 - DNA, 33 bp, homo sapien
tggtttggatgaaaggycagagttggtccttga

SEQ ID NO: 4862 - DNA, 33 bp, homo sapien
atttgcttcttcctagycaatctcctgttgaag

SEQ ID NO: 4863 - DNA, 33 bp, homo sapien
taatacttcaggcttcrcaggccatgcagtctc

SEQ ID NO: 4864 - DNA, 33 bp, homo sapien
tatgatagatagatacratagctagatggagat

SEQ ID NO: 4865 - DNA, 33 bp, homo sapien
agctgtgaacagcatcrgcaacgagttggcact

SEQ ID NO: 4866 - DNA, 33 bp, homo sapien
gacacgctcacacatckgtattcaaattcttat

SEQ ID NO: 4867 - DNA, 33 bp, homo sapien
gacaatttgttagaacycatggttgccacgagt

SEQ ID NO: 4868 - DNA, 33 bp, homo sapien
gaatgtgaaaagactasagtggcttagcctccc

SEQ ID NO: 4869 - DNA, 33 bp, homo sapien
agatagtgagattactrggtttgcttttagtgg

SEQ ID NO: 4870 - DNA, 33 bp, homo sapien
tttcacaattccagcaygtctcaattcagagta

SEQ ID NO: 4871 - DNA, 33 bp, homo sapien
ttctctctctcattctyacaaatgtgcacatac

SEQ ID NO: 4872 - DNA, 33 bp, homo sapien
tgttgggaaattgtagygccttctaaaaaaact

SEQ ID NO: 4873 - DNA, 33 bp, homo sapien
gtgtaatgtgaacagakaagtgaccacagaatc

SEQ ID NO: 4874 - DNA, 33 bp, homo sapien
gcattaatgtaatcccrcgtaagtttcgaaaaa

SEQ ID NO: 4875 - DNA, 33 bp, homo sapien
tacattgttcaaagatrtacgcatgagatgttc

SEQ ID NO: 4876 - DNA, 33 bp, homo sapien
gtgctgttcagtgatgkctgagtgctggccaca

SEQ ID NO: 4877 - DNA, 33 bp, homo sapien
gtcaaagcataaagaamaagtagcacattggat

SEQ ID NO: 4878 - DNA, 33 bp, homo sapien
cttcttcagctgggacrgttgtcactattcaca

SEQ ID NO: 4879 - DNA, 33 bp, homo sapien
cactcttaagtgaaatrtctcttcatgactctt

SEQ ID NO: 4880 - DNA, 33 bp, homo sapien
ccactacaaggataagraaacaaaaagtactta

SEQ ID NO: 4881 - DNA, 33 bp, homo sapien
ttgaccacaggtaccaraatgattcactagttt

SEQ ID NO: 4882 - DNA, 33 bp, homo sapien
tctaattttcagccacrtttatttactgtctgt

SEQ ID NO: 4883 - DNA, 33 bp, homo sapien
ttgcaacatttcccttygggttccagcctcaca

SEQ ID NO: 4884 - DNA, 33 bp, homo sapien
tctctaccctggagaaytttatagtccagttga

SEQ ID NO: 4885 - DNA, 33 bp, homo sapien
aaactaatcttatgagrccactattactctgat

SEQ ID NO: 4886 - DNA, 33 bp, homo sapien
tcaaatatgtacaactrggaagtatgagggaaa

SEQ ID NO: 4887 - DNA, 33 bp, homo sapien
gatgcagtttttagtgygacctggcactatgcc

SEQ ID NO: 4888 - DNA, 33 bp, homo sapien
cagcattctgatcttcwccctgaatgagtaaaa

SEQ ID NO: 4889 - DNA, 33 bp, homo sapien
attaatctaagacttcrgaaagaaacaaaccca

SEQ ID NO: 4890 - DNA, 33 bp, homo sapien
tcacaactggtgatacygtttgacctaagtgtt

SEQ ID NO: 4891 - DNA, 33 bp, homo sapien
gactactgcctagattrcttatgttttaggggt

SEQ ID NO: 4892 - DNA, 33 bp, homo sapien
attgcagatgaaagacraaagtacctctgattg

SEQ ID NO: 4893 - DNA, 33 bp, homo sapien
tttgggaaggtcagttragagaagactaaagta

SEQ ID NO: 4894 - DNA, 33 bp, homo sapien
gttgggatcatatagtktgtaacctttgcagac

SEQ ID NO: 4895 - DNA, 33 bp, homo sapien
tcttgttcatcactccygattgctctcagatta

SEQ ID NO: 4896 - DNA, 33 bp, homo sapien
cttgcttatgtgtcttygtctttaacatcaaag

SEQ ID NO: 4897 - DNA, 33 bp, homo sapien
ctgtattttctgtagcrtgtatttacattgatt

SEQ ID NO: 4898 - DNA, 33 bp, homo sapien
ttgtgcatcttattccrtggacatcaggcttgt

SEQ ID NO: 4899 - DNA, 33 bp, homo sapien
ccagggttcatacaatragctcaagaaacaaag

SEQ ID NO: 4900 - DNA, 33 bp, homo sapien
aagaactctccatgtawtctgaaaaatcaaatg

SEQ ID NO: 4901 - DNA, 33 bp, homo sapien
ctcctccaatcaattaytgacttaacaatcaga

SEQ ID NO: 4902 - DNA, 33 bp, homo sapien
agctcttccaaggttcygtgcaccaaatcacta

SEQ ID NO: 4903 - DNA, 33 bp, homo sapien
aatattaagagtattgwctccttcatgcactac

SEQ ID NO: 4904 - DNA, 33 bp, homo sapien
tagagacttaggcattygttcttatcaggttta

SEQ ID NO: 4905 - DNA, 33 bp, homo sapien
tagattacttgtaattkcaagtgcaaaaacctt

SEQ ID NO: 4906 - DNA, 33 bp, homo sapien
ccattattgagtacctrttgatatgtgtggtgt

SEQ ID NO: 4907 - DNA, 33 bp, homo sapien
ccttctttaggtattayggtggaagaatgtgct

SEQ ID NO: 4908 - DNA, 33 bp, homo sapien
aaagcaaacaaaccagraaatggtataccaaaa

SEQ ID NO: 4909 - DNA, 33 bp, homo sapien
gaagggttcaaggaagmcaatgacagataaagg

SEQ ID NO: 4910 - DNA, 33 bp, homo sapien
tcttatggagaattgcytttggtgcctctttca

SEQ ID NO: 4911 - DNA, 33 bp, homo sapien
gagactgcaagactgcragaaatacctaagtct

SEQ ID NO: 4912 - DNA, 33 bp, homo sapien
gagtcaaaagccattgyaaaatttgaaaccaag

SEQ ID NO: 4913 - DNA, 33 bp, homo sapien
cagaggatttctagtayagtagcaagcataaat

SEQ ID NO: 4914 - DNA, 33 bp, homo sapien
agcagcagcactcactrtaatttctgatattgc

SEQ ID NO: 4915 - DNA, 33 bp, homo sapien
gattggaaaatgatacyctacatacaaaatact

SEQ ID NO: 4916 - DNA, 33 bp, homo sapien
tcgttgatgtttcacamgactgctcttacaaaa

SEQ ID NO: 4917 - DNA, 33 bp, homo sapien
aacttagtgtgattagytgtaattagctgaaat

SEQ ID NO: 4918 - DNA, 33 bp, homo sapien
aagctcagaatggttargtaacttgccaaaggt

SEQ ID NO: 4919 - DNA, 33 bp, homo sapien
agttgaatttttctccygtaatgcataatcagg

SEQ ID NO: 4920 - DNA, 33 bp, homo sapien
gtcagcctttacataayagtagtcataccctgt

SEQ ID NO: 4921 - DNA, 33 bp, homo sapien
agtttctggtttcaagyggtgagcctagctcta

SEQ ID NO: 4922 - DNA, 33 bp, homo sapien
tacattttattatgtgrtttttcctgcttaaaa

SEQ ID NO: 4923 - DNA, 33 bp, homo sapien
gcccttcttttcacatrgttaaccaatcaatca

SEQ ID NO: 4924 - DNA, 33 bp, homo sapien
atttggatctacttagyattttgcctacctcgt

SEQ ID NO: 4925 - DNA, 33 bp, homo sapien
ataaaaataacttacaraaattgagaaaggtac

SEQ ID NO: 4926 - DNA, 33 bp, homo sapien
agaaaaacgtgacctcrtcaaatgaactaaata

SEQ ID NO: 4927 - DNA, 33 bp, homo sapien
agacacacaagcatagrccaaaaatgtggagaa

SEQ ID NO: 4928 - DNA, 33 bp, homo sapien
atataatcaaagggcamgcttcaggatgttgtt

SEQ ID NO: 4929 - DNA, 33 bp, homo sapien
aaaaacttctttttgcscaatttgtaagactta

SEQ ID NO: 4930 - DNA, 33 bp, homo sapien
cttcatcagtgtgcacyttatcccactccaccc

SEQ ID NO: 4931 - DNA, 33 bp, homo sapien
cctacatgagagattcygacagtttcttgccac

SEQ ID NO: 4932 - DNA, 33 bp, homo sapien
taagtcttctaacttaytattcacacatgctac

SEQ ID NO: 4933 - DNA, 33 bp, homo sapien
tctctagctcttcttcrttagaactgttctaga

SEQ ID NO: 4934 - DNA, 33 bp, homo sapien
cttccaattaaaacctyggtggtgaagatttag

SEQ ID NO: 4935 - DNA, 33 bp, homo sapien
ttcctcatcagtaaagyggattcacctgtttgc

SEQ ID NO: 4936 - DNA, 33 bp, homo sapien
aagttttcagaaagcaktaccttttccataagc

SEQ ID NO: 4937 - DNA, 33 bp, homo sapien
agtctctatgtgttcartacagatgcagccatc

SEQ ID NO: 4938 - DNA, 33 bp, homo sapien
catgcatgtctttcccygtcgactgactcaaat

SEQ ID NO: 4939 - DNA, 33 bp, homo sapien
gactcttcttggtgtcrtctttctttactaaga

SEQ ID NO: 4940 - DNA, 33 bp, homo sapien
tttaaatcacctctgarttacttgtaataccta

SEQ ID NO: 4941 - DNA, 33 bp, homo sapien
aattgcttgcggaacgygttataaatgaatatt

SEQ ID NO: 4942 - DNA, 33 bp, homo sapien
tgaaaggtgtacaaaasaatagaaaagtgggcc

SEQ ID NO: 4943 - DNA, 33 bp, homo sapien
gttagcaatgttctaayagttcaaattaagctt

SEQ ID NO: 4944 - DNA, 33 bp, homo sapien
tattcagtttccagggyttagaatgtggatagt

SEQ ID NO: 4945 - DNA, 33 bp, homo sapien
gagggaagaaccaatayggtaatggcatgtgag

SEQ ID NO: 4946 - DNA, 33 bp, homo sapien
tctcaccctagaggccrctgtactttttctccc

SEQ ID NO: 4947 - DNA, 33 bp, homo sapien
tacaagatgcctatgtrcgtggtatagctgaat

SEQ ID NO: 4948 - DNA, 33 bp, homo sapien
tttagccactagcttcrtgatcatttgttacag

SEQ ID NO: 4949 - DNA, 33 bp, homo sapien
ggcacatgtcacctaayagcatgtggccctggc

SEQ ID NO: 4950 - DNA, 33 bp, homo sapien
gcacccagggcacaaarcaaagtcctcccccca

SEQ ID NO: 4951 - DNA, 33 bp, homo sapien
gagcagtgaagacagtwacacagcaggatccta

SEQ ID NO: 4952 - DNA, 33 bp, homo sapien
tttctattcctcaacargccaaattcagtgaat

SEQ ID NO: 4953 - DNA, 33 bp, homo sapien
atggctttaatggaaawctctttcagtttcttg

SEQ ID NO: 4954 - DNA, 33 bp, homo sapien
gaaaaggcgaacgcaarcataataagttgtcag

SEQ ID NO: 4955 - DNA, 33 bp, homo sapien
tatctttacaaagatgygtcttttcctgctgct

SEQ ID NO: 4956 - DNA, 33 bp, homo sapien
tttcctgaactaaaaartttattggaggctctc

SEQ ID NO: 4957 - DNA, 33 bp, homo sapien
ttcttatcatttgtgcrttcactgaagtagcac

SEQ ID NO: 4958 - DNA, 33 bp, homo sapien
atggctctcttctaacyatcttattctcaagtt

SEQ ID NO: 4959 - DNA, 33 bp, homo sapien
aattataagacagttaktcatcaagatccattt

SEQ ID NO: 4960 - DNA, 33 bp, homo sapien
actttaagtcaagtatrtaatgacaaaaactac

SEQ ID NO: 4961 - DNA, 33 bp, homo sapien
tagagagtacaaaaagscatgttaaaaaatacc

SEQ ID NO: 4962 - DNA, 33 bp, homo sapien
acatacaaactcaaaamaagtctgaagaagaga

SEQ ID NO: 4963 - DNA, 33 bp, homo sapien
attgtgtgactgttccrtaagttatgtattcat

SEQ ID NO: 4964 - DNA, 33 bp, homo sapien
tcctcaatgctccaacktggtcttctcatgtca

SEQ ID NO: 4965 - DNA, 33 bp, homo sapien
tcacatatgagagcccrataactgtgaataaac

SEQ ID NO: 4966 - DNA, 33 bp, homo sapien
gatgacagaggaggagrctttggtagtcaacag

SEQ ID NO: 4967 - DNA, 33 bp, homo sapien
gcaaagtaaatgtcatyttgagtgttaatggat

SEQ ID NO: 4968 - DNA, 33 bp, homo sapien
cttatgtttgataagcrtatcagacatagtgga

SEQ ID NO: 4969 - DNA, 33 bp, homo sapien
ctggctttcttctggtygaattgggaataaatt

SEQ ID NO: 4970 - DNA, 33 bp, homo sapien
aaccctcaaaaaaaatrctaggaaactgaattc

SEQ ID NO: 4971 - DNA, 33 bp, homo sapien
aaagtgataaaacccarcaaatcatcgattagg

SEQ ID NO: 4972 - DNA, 33 bp, homo sapien
ccatcttagtccctttrtgcttctatataggcc

SEQ ID NO: 4973 - DNA, 33 bp, homo sapien
atgtgagccatcttttygcccctgctaatggag

SEQ ID NO: 4974 - DNA, 33 bp, homo sapien
ccaggcacgagagagawtcgccttgtctgccgg

SEQ ID NO: 4975 - DNA, 33 bp, homo sapien
ctgtgtctctgaggagytaccatttgagcagag

SEQ ID NO: 4976 - DNA, 33 bp, homo sapien
aaaaggaaaagagaaaragatgagtaagcattt

SEQ ID NO: 4977 - DNA, 33 bp, homo sapien
tatatctccagccaaastgcctgaagtatctcc

SEQ ID NO: 4978 - DNA, 33 bp, homo sapien
tgctgttatttaggtcrtatttatttcaaagca

SEQ ID NO: 4979 - DNA, 33 bp, homo sapien
gacaaagagtagcatgygattctaataatgaaa

SEQ ID NO: 4980 - DNA, 33 bp, homo sapien
tcacagagtgagtgttkctccagctctctgttt

SEQ ID NO: 4981 - DNA, 33 bp, homo sapien
tactactgtgacctatrgcatgtccttgaggat

SEQ ID NO: 4982 - DNA, 33 bp, homo sapien
aatgccagtctgggtckgcccaaagcaaacatt

SEQ ID NO: 4983 - DNA, 33 bp, homo sapien
aagggcagtttttcacrgcaccttgatgaaggt

SEQ ID NO: 4984 - DNA, 33 bp, homo sapien
gtattcttatgacaatrtatctgtgaggattcc

SEQ ID NO: 4985 - DNA, 33 bp, homo sapien
catagttctacatgtgyatgttggatgtgtgtg

SEQ ID NO: 4986 - DNA, 33 bp, homo sapien
cttataaaatagaaagsgtaggttgattgattc

SEQ ID NO: 4987 - DNA, 33 bp, homo sapien
ctatgctttgtgaatgyctgttaacttaggtca

SEQ ID NO: 4988 - DNA, 33 bp, homo sapien
gataacaggcagtagcrgtcctgaagaacagtg

SEQ ID NO: 4989 - DNA, 33 bp, homo sapien
ataatttctacctaagkgtaatcttctacaacg

SEQ ID NO: 4990 - DNA, 33 bp, homo sapien
gaggctggaaatgagtrggtactgctaaaacaa

SEQ ID NO: 4991 - DNA, 33 bp, homo sapien
acaaagacttgcccacmaatagtcacagcaact

SEQ ID NO: 4992 - DNA, 33 bp, homo sapien
aaacttaagctcatagrcatgtttaaaatttcc

SEQ ID NO: 4993 - DNA, 33 bp, homo sapien
tcttgaaattaaaacaytgatgagaccttagat

SEQ ID NO: 4994 - DNA, 33 bp, homo sapien
catgaatgaattttccygagggcaggagaggca

SEQ ID NO: 4995 - DNA, 33 bp, homo sapien
tgttttgttgatgctawgcttgcatgtaaatag

SEQ ID NO: 4996 - DNA, 33 bp, homo sapien
atagatatcatttagtrtaacattgatgccgcc

SEQ ID NO: 4997 - DNA, 33 bp, homo sapien
ttgtattttagaagccrcaagtttaaagaaaaa

SEQ ID NO: 4998 - DNA, 33 bp, homo sapien
agaaggtaaaacatagyatggaagacaggtcaa

SEQ ID NO: 4999 - DNA, 33 bp, homo sapien
aagggaatctgagcatstcagaatagccctctt

SEQ ID NO: 5000 - DNA, 33 bp, homo sapien
acaaaaacaggcaaccmaagcaacaattgacaa

SEQ ID NO: 5001 - DNA, 33 bp, homo sapien
catgttttatttaatgyttggtattatgtgagt

SEQ ID NO: 5002 - DNA, 33 bp, homo sapien
gtaagtggacagcctcmttctcaagacaaaact

SEQ ID NO: 5003 - DNA, 33 bp, homo sapien
ggttacagtattatagytggtacataaagaacc

SEQ ID NO: 5004 - DNA, 33 bp, homo sapien
catcaacatttccatcrgaatttgagtagcttc

SEQ ID NO: 5005 - DNA, 33 bp, homo sapien
tgagtatgaggctactktttccatccactagtg

SEQ ID NO: 5006 - DNA, 33 bp, homo sapien
gtgttcactgtgaacaygtttcttgtgtatcct

SEQ ID NO: 5007 - DNA, 33 bp, homo sapien
agggcaaggaataaatkaactcaagtaagtaat

SEQ ID NO: 5008 - DNA, 33 bp, homo sapien
ccccttctttcctcaakggatcaaatcaaacct

SEQ ID NO: 5009 - DNA, 33 bp, homo sapien
actgcttatctactgayactgttttcacactta

SEQ ID NO: 5010 - DNA, 33 bp, homo sapien
acttgagggtagcacayatccagaaacatcagt

SEQ ID NO: 5011 - DNA, 33 bp, homo sapien
gtattgctaagtagtaytccattttatgaatat

SEQ ID NO: 5012 - DNA, 33 bp, homo sapien
aggaaaaaggctctagstattattaacagcagt

SEQ ID NO: 5013 - DNA, 33 bp, homo sapien
caaggcggatccctgartgccacacttcctgta

SEQ ID NO: 5014 - DNA, 33 bp, homo sapien
agaaaggctctgttacractctcctggggctct

SEQ ID NO: 5015 - DNA, 33 bp, homo sapien
ttatggttttaatttgygtccctaatagctaat

SEQ ID NO: 5016 - DNA, 33 bp, homo sapien
cacgtggcttaactgaktatcctaaggtgttat

SEQ ID NO: 5017 - DNA, 33 bp, homo sapien
ctttatgtacgttcaarttcctcaattattgtt

SEQ ID NO: 5018 - DNA, 33 bp, homo sapien
gagccagagaatcctgytaagcaatacccagat

SEQ ID NO: 5019 - DNA, 33 bp, homo sapien
gtctcatgctgcagtckcattttcaaggaagcc

SEQ ID NO: 5020 - DNA, 33 bp, homo sapien
atttgtttatcgtggtrtaacaggcactgcatg

SEQ ID NO: 5021 - DNA, 33 bp, homo sapien
tcaatgaacatttattmtctctgggctgtgccc

SEQ ID NO: 5022 - DNA, 33 bp, homo sapien
acttcagccattacaargttaggaaaaaccacg

SEQ ID NO: 5023 - DNA, 33 bp, homo sapien
gaaggtagtgcagctayggaaggcaatcaaggt

SEQ ID NO: 5024 - DNA, 33 bp, homo sapien
actggcaaaaccagctygtggacaaacatatct

SEQ ID NO: 5025 - DNA, 33 bp, homo sapien
aaaaagcacaacacagkattagcacataaaaag

SEQ ID NO: 5026 - DNA, 33 bp, homo sapien
ctttttttgtttttatwgaggcggagtttcgct

SEQ ID NO: 5027 - DNA, 33 bp, homo sapien
acacaaacttaggaacrtattttatgagaaaca

SEQ ID NO: 5028 - DNA, 33 bp, homo sapien
gtaatacactgtggcarcttcagaaatcagatt

SEQ ID NO: 5029 - DNA, 33 bp, homo sapien
acacagtttttaaaacytgatggacctttgtga

SEQ ID NO: 5030 - DNA, 33 bp, homo sapien
gtactgctacatgctawaatgtgaatgatccct

SEQ ID NO: 5031 - DNA, 33 bp, homo sapien
attctgtcattaaaaaygatgccagaagtgtgg

SEQ ID NO: 5032 - DNA, 33 bp, homo sapien
aaacatgttttcacatyggtcactttaaaaaaa

SEQ ID NO: 5033 - DNA, 33 bp, homo sapien
gagactctgtacgataycataatggtggataca

SEQ ID NO: 5034 - DNA, 33 bp, homo sapien
cttgcacatggggtttrataaggtttcaaagtc

SEQ ID NO: 5035 - DNA, 33 bp, homo sapien
ctgtctttgaccacagsctggcacaggagttaa

SEQ ID NO: 5036 - DNA, 33 bp, homo sapien
cttgttagcataatggmcttgtgaccagagcca

SEQ ID NO: 5037 - DNA, 33 bp, homo sapien
ttttcctctggcgtgasttcatcttgactaatt

SEQ ID NO: 5038 - DNA, 33 bp, homo sapien
aacatattaaatcactsttagtacgcagagtgg

SEQ ID NO: 5039 - DNA, 33 bp, homo sapien
tcacgttttatttgtasactgggcctttgctct

SEQ ID NO: 5040 - DNA, 33 bp, homo sapien
ctgtacagaactatagkgtgcctttcattaaaa

SEQ ID NO: 5041 - DNA, 33 bp, homo sapien
gacagatgaggaaaccragttatggtctactaa

SEQ ID NO: 5042 - DNA, 33 bp, homo sapien
ccaaccgggcataaagrcttgacattctgcaca

SEQ ID NO: 5043 - DNA, 33 bp, homo sapien
gttacgactcagccacrttgcatactctgatta

SEQ ID NO: 5044 - DNA, 33 bp, homo sapien
gaaaatgtgatgtttgrtatggacgtgaaggca

SEQ ID NO: 5045 - DNA, 33 bp, homo sapien
aggaagaacaccatttratctttaaaacaagca

SEQ ID NO: 5046 - DNA, 33 bp, homo sapien
ttgttgaagatcaaatrgttgcaggtgtgtggc

SEQ ID NO: 5047 - DNA, 33 bp, homo sapien
aggctgaatccaagatyataaacccaagttaca

SEQ ID NO: 5048 - DNA, 33 bp, homo sapien
gaatcagtaacttcctrtaagctgaaagtattt

SEQ ID NO: 5049 - DNA, 33 bp, homo sapien
gaggaagcctcaggaaktttacaagcatggtgg

SEQ ID NO: 5050 - DNA, 33 bp, homo sapien
tgtatatcatctttgcygtgatttgagtcacac

SEQ ID NO: 5051 - DNA, 33 bp, homo sapien
taatctcaacactttgraaacccaaggcaggag

SEQ ID NO: 5052 - DNA, 33 bp, homo sapien
tcaataatgatcccaarttcacacaggtagtga

SEQ ID NO: 5053 - DNA, 33 bp, homo sapien
agttcaaagccagctcrtagacagtatctgctt

SEQ ID NO: 5054 - DNA, 33 bp, homo sapien
taactaaagcctttcawtgttacactatgcaat

SEQ ID NO: 5055 - DNA, 33 bp, homo sapien
actgatgctggatctgytttactagcacatttc

SEQ ID NO: 5056 - DNA, 33 bp, homo sapien
tggtacagttaaaacayagtatgcatgaagaca

SEQ ID NO: 5057 - DNA, 33 bp, homo sapien
agaggatagagaagcaycctgaagcctggtgga

SEQ ID NO: 5058 - DNA, 33 bp, homo sapien
tctaggaataagaaacsacagatggaaaagtat

SEQ ID NO: 5059 - DNA, 33 bp, homo sapien
accagcaggaatctcaytaccctcatatctgga

SEQ ID NO: 5060 - DNA, 33 bp, homo sapien
gtggttcagctgatccrcagtatcttccatacc

SEQ ID NO: 5061 - DNA, 33 bp, homo sapien
agaacccttactttcaytttgcattttttgaac

SEQ ID NO: 5062 - DNA, 33 bp, homo sapien
tgtgaattcaaccacartgaaggaattattgtc

SEQ ID NO: 5063 - DNA, 33 bp, homo sapien
gcgaaggaatttgtatyttattgtaaggaaagc

SEQ ID NO: 5064 - DNA, 33 bp, homo sapien
tggaggtctttatgctwctcattcctacacctc

SEQ ID NO: 5065 - DNA, 33 bp, homo sapien
gagtctgagctataacsacattcacgtggagcc

SEQ ID NO: 5066 - DNA, 33 bp, homo sapien
tgttcagttaatgtgayttttgtttttagtttt

SEQ ID NO: 5067 - DNA, 33 bp, homo sapien
ggacctggcctgcaccyatgggatggaaactct

SEQ ID NO: 5068 - DNA, 33 bp, homo sapien
atcattctctcacatgyttttacagtcttctgt

SEQ ID NO: 5069 - DNA, 33 bp, homo sapien
taagcaaagatccctcrcttggagatgtggtag

SEQ ID NO: 5070 - DNA, 33 bp, homo sapien
tcctgtgtgtgctgaaragatgggacaaatgtc

SEQ ID NO: 5071 - DNA, 33 bp, homo sapien
aattacccgtatttaamcagcaatccaaaggac

SEQ ID NO: 5072 - DNA, 33 bp, homo sapien
tattaaggaatctattwttatcttcatgttgta

SEQ ID NO: 5073 - DNA, 33 bp, homo sapien
tgagttccaccaaatcragaggtaaaccaagaa

SEQ ID NO: 5074 - DNA, 33 bp, homo sapien
tttcaattaaacttcastgctttcaaagtggtg

SEQ ID NO: 5075 - DNA, 33 bp, homo sapien
atggggagactggagaygaggtacagttttatt

SEQ ID NO: 5076 - DNA, 33 bp, homo sapien
tgcttcatatatttttsaaactacctccatgat

SEQ ID NO: 5077 - DNA, 33 bp, homo sapien
ctttaatctgtatttgyttgaatggtgaagtca

SEQ ID NO: 5078 - DNA, 33 bp, homo sapien
ctggttttgaacttggrgacttagattactctt

SEQ ID NO: 5079 - DNA, 33 bp, homo sapien
atcccttgtctgtaccwgaaaattcctccaacg

SEQ ID NO: 5080 - DNA, 33 bp, homo sapien
tttaagctggccatgcrtcaataacataatact

SEQ ID NO: 5081 - DNA, 33 bp, homo sapien
ctgacacacagctagawgacacttaccagcttt

SEQ ID NO: 5082 - DNA, 33 bp, homo sapien
tctccagagcaatgtaraaatcacagcacattt

SEQ ID NO: 5083 - DNA, 33 bp, homo sapien
gacctgctttaaaaaargaaagacggcgatttg

SEQ ID NO: 5084 - DNA, 33 bp, homo sapien
gggcccacaattttcartatggtaattaagcag

SEQ ID NO: 5085 - DNA, 33 bp, homo sapien
ctgtttcatctgcagcragcatctgttatttag

SEQ ID NO: 5086 - DNA, 33 bp, homo sapien
attctgagtgctttccrtttgctaattcatgga

SEQ ID NO: 5087 - DNA, 33 bp, homo sapien
cagcaacctatttatayacataagccactttca

SEQ ID NO: 5088 - DNA, 33 bp, homo sapien
gatttctataaaagacrtagatcacctagaaca

SEQ ID NO: 5089 - DNA, 33 bp, homo sapien
cagggtttcatgattascaagtggcagagcctg

SEQ ID NO: 5090 - DNA, 33 bp, homo sapien
acgtaattgtaaatatrggattaaagtgcaagt

SEQ ID NO: 5091 - DNA, 33 bp, homo sapien
ttttattttatttatcygacatttttctttttt

SEQ ID NO: 5092 - DNA, 33 bp, homo sapien
agtgatgagaactgccrtaaccagaaaagatta

SEQ ID NO: 5093 - DNA, 33 bp, homo sapien
tttcttaatacctaatrtaatgtctgatactct

SEQ ID NO: 5094 - DNA, 33 bp, homo sapien
ttaaaaggtgcttccgmaaggattcttacttga

SEQ ID NO: 5095 - DNA, 33 bp, homo sapien
cccagattcaaacggasctctgcaactttcaag

SEQ ID NO: 5096 - DNA, 33 bp, homo sapien
taactttcctcatgaaytggcattctttctttt

SEQ ID NO: 5097 - DNA, 33 bp, homo sapien
cctacaaaaactcacamaatgcccaaagaatca

SEQ ID NO: 5098 - DNA, 33 bp, homo sapien
aaggaaacaagaagcaktaaattactttttccc

SEQ ID NO: 5099 - DNA, 33 bp, homo sapien
taagcacagactgtgaygactacaataaatacc

SEQ ID NO: 5100 - DNA, 33 bp, homo sapien
tctagtggtaatatgcrtaattttggaacagaa

SEQ ID NO: 5101 - DNA, 33 bp, homo sapien
ggggatactaacatgcygtccatagcagaattg

SEQ ID NO: 5102 - DNA, 33 bp, homo sapien
gtgtcctgagaatttgyaggtctaacaagtttc

SEQ ID NO: 5103 - DNA, 33 bp, homo sapien
gagacgttctttttttyggttatctgtgataga

SEQ ID NO: 5104 - DNA, 33 bp, homo sapien
catgccggaatacatcwattcatcttcttttaa

SEQ ID NO: 5105 - DNA, 33 bp, homo sapien
tcccctggcctcagcarctccattcacttcccc

SEQ ID NO: 5106 - DNA, 33 bp, homo sapien
ttttctcagtgtaaacrtcaaagatcttataag

SEQ ID NO: 5107 - DNA, 33 bp, homo sapien
ttagttgtaggctcatrtgtaaaagttgggata

SEQ ID NO: 5108 - DNA, 33 bp, homo sapien
tagcatttccaaatagytgaactgtaaaccacc

SEQ ID NO: 5109 - DNA, 33 bp, homo sapien
tgtacagatgattttgsttgtccttagataaaa

SEQ ID NO: 5110 - DNA, 33 bp, homo sapien
ctttaccaagtacaatwatgtcggagtctaaaa

SEQ ID NO: 5111 - DNA, 33 bp, homo sapien
gggcaaaaaagggcacmaagaaaagagtagtca

SEQ ID NO: 5112 - DNA, 33 bp, homo sapien
atcggcattgtgaaaaratagatggaaggagat

SEQ ID NO: 5113 - DNA, 33 bp, homo sapien
cattgctatccctatayaccaaggtttgctatt

SEQ ID NO: 5114 - DNA, 33 bp, homo sapien
ctcatatacagtcctcrtcaacacacaaagtga

SEQ ID NO: 5115 - DNA, 33 bp, homo sapien
acctacgaggcatgatycccaaattgaagttct

SEQ ID NO: 5116 - DNA, 33 bp, homo sapien
ttcttttgcttaatcarttctgcttttaaaaga

SEQ ID NO: 5117 - DNA, 33 bp, homo sapien
gaaggtattacaagtcrtgccacagaaataaaa

SEQ ID NO: 5118 - DNA, 33 bp, homo sapien
attcccagctccctgcrccagtacttggctgta

SEQ ID NO: 5119 - DNA, 33 bp, homo sapien
acagatggcaaattagytgggtttataattaca

SEQ ID NO: 5120 - DNA, 33 bp, homo sapien
tcagcgtgggcctatgrtcaagcctggccaagg

SEQ ID NO: 5121 - DNA, 33 bp, homo sapien
aggctaagctggctaakctggtgagtgacaggg

SEQ ID NO: 5122 - DNA, 33 bp, homo sapien
acaatgcaaaaggtacraaaaccaatggaaaaa

SEQ ID NO: 5123 - DNA, 33 bp, homo sapien
tccctgacatcactccytcctggttttcttcct

SEQ ID NO: 5124 - DNA, 33 bp, homo sapien
ttcagcaaaaggcatgrtcttgctgggacggct

SEQ ID NO: 5125 - DNA, 33 bp, homo sapien
gggtcactagcacatcytgaatgacaaggtttc

SEQ ID NO: 5126 - DNA, 33 bp, homo sapien
gttataaaacagagggwccgaaagactctcaca

SEQ ID NO: 5127 - DNA, 33 bp, homo sapien
ccctatatattaaacakaacagggcccatgagc

SEQ ID NO: 5128 - DNA, 33 bp, homo sapien
aatataaaaggaaaagkcttaaatgccctaaga

SEQ ID NO: 5129 - DNA, 33 bp, homo sapien
taatggacaggtgaaakgtcagcaacctagaaa

SEQ ID NO: 5130 - DNA, 33 bp, homo sapien
ccctggcaaccaaagarggagcttttacaccag

SEQ ID NO: 5131 - DNA, 33 bp, homo sapien
tgtattaagagctgacygtataaacgatgaaaa

SEQ ID NO: 5132 - DNA, 33 bp, homo sapien
aagctgtataactcaartctttgatcttcacca

SEQ ID NO: 5133 - DNA, 33 bp, homo sapien
agcctgccatgagtacrttttcaggctcgttaa

SEQ ID NO: 5134 - DNA, 33 bp, homo sapien
gagtacagagaatctcrtttcttgactaagcaa

SEQ ID NO: 5135 - DNA, 33 bp, homo sapien
agctactacttgcttcstggacttgccatttac

SEQ ID NO: 5136 - DNA, 33 bp, homo sapien
aatattggcaactaatrtcaccatgagactcag

SEQ ID NO: 5137 - DNA, 33 bp, homo sapien
acttcagctcttctctyatggtaatacaatgac

SEQ ID NO: 5138 - DNA, 33 bp, homo sapien
gtgggatggtggtgccrttagtcaggatgacag

SEQ ID NO: 5139 - DNA, 33 bp, homo sapien
acaaatctccatgttgratattcccagtgcaca

SEQ ID NO: 5140 - DNA, 33 bp, homo sapien
taatgcagaggtttggytacacagatgatggag

SEQ ID NO: 5141 - DNA, 33 bp, homo sapien
ttctgaaatttgtcgtmgtctggaactattttg

SEQ ID NO: 5142 - DNA, 33 bp, homo sapien
tctaaatttcctggagscacctctgggccagag

SEQ ID NO: 5143 - DNA, 33 bp, homo sapien
ggtagaacaaatgcagygaaatgttaattgttg

SEQ ID NO: 5144 - DNA, 33 bp, homo sapien
gctggggaaaataagcrcgtcctgtgtgattgc

SEQ ID NO: 5145 - DNA, 33 bp, homo sapien
tctaatcactggggcaygaagactccaagttag

SEQ ID NO: 5146 - DNA, 33 bp, homo sapien
tcaagcagttcaaatamaaagtgatgtagatag

SEQ ID NO: 5147 - DNA, 33 bp, homo sapien
cacagtaatactattcmtaacaaccctcaactg

SEQ ID NO: 5148 - DNA, 33 bp, homo sapien
caccatcagtgataacrttgaaagttgacaagc

SEQ ID NO: 5149 - DNA, 33 bp, homo sapien
ctctaaaaatccatcarcttataatttaatact

SEQ ID NO: 5150 - DNA, 33 bp, homo sapien
attgcagcaacagaaayctattaagatcctttg

SEQ ID NO: 5151 - DNA, 33 bp, homo sapien
aatacaaatcaggtaakgaatacaggtgtgtcc

SEQ ID NO: 5152 - DNA, 33 bp, homo sapien
agaggatactgagacarctcatgaagactctgt

SEQ ID NO: 5153 - DNA, 33 bp, homo sapien
atattcactccaaatawaactgtatttatggat

SEQ ID NO: 5154 - DNA, 33 bp, homo sapien
cttagccaaagtgtctyacatctaaatcttcct

SEQ ID NO: 5155 - DNA, 33 bp, homo sapien
gtgttttaagagcggtmgtggcatgtccctaga

SEQ ID NO: 5156 - DNA, 33 bp, homo sapien
ccaagacagaattggartttagtctcagtgtgt

SEQ ID NO: 5157 - DNA, 33 bp, homo sapien
gctgtttccccaggtcrtttgggttttcccaca

SEQ ID NO: 5158 - DNA, 33 bp, homo sapien
tgcacaatgaggagacrcaatttaataaaaaga

SEQ ID NO: 5159 - DNA, 33 bp, homo sapien
actttgcaaacacaagygcaataaagatgttta

SEQ ID NO: 5160 - DNA, 33 bp, homo sapien
tctttgccaaatttgtytaatgggaatctctcc

SEQ ID NO: 5161 - DNA, 33 bp, homo sapien
ataggaatttaacaggmgcttcaggtttgttgg

SEQ ID NO: 5162 - DNA, 33 bp, homo sapien
taatgtaaagttgatcrttttaaacaccttaca

SEQ ID NO: 5163 - DNA, 33 bp, homo sapien
gtctctgccacactatrtttattccccttgcac

SEQ ID NO: 5164 - DNA, 33 bp, homo sapien
cagtggggctcaagagraagtaagaaatctgtt

SEQ ID NO: 5165 - DNA, 33 bp, homo sapien
agaaattgtttaagacrtactagagctttgtac

SEQ ID NO: 5166 - DNA, 33 bp, homo sapien
ctctattccagccattrtcattatccattatca

SEQ ID NO: 5167 - DNA, 33 bp, homo sapien
tcttggatttatttcaytgatgctttatccccg

SEQ ID NO: 5168 - DNA, 33 bp, homo sapien
accagataccaagaagrcaaaaaactctccatg

SEQ ID NO: 5169 - DNA, 33 bp, homo sapien
ctctggttaaatgaaaycttctagctgtttctt

SEQ ID NO: 5170 - DNA, 33 bp, homo sapien
taaactactaaaattaygaaatatctcttttga

SEQ ID NO: 5171 - DNA, 33 bp, homo sapien
atcgattctcactataytgttttataatttttt

SEQ ID NO: 5172 - DNA, 33 bp, homo sapien
gagagacagaatgagcsagggcctagaggaaaa

SEQ ID NO: 5173 - DNA, 33 bp, homo sapien
actcagattgccttagragacttttaaagttct

SEQ ID NO: 5174 - DNA, 33 bp, homo sapien
tttgaaccacttctacwacatttaatttagcct

SEQ ID NO: 5175 - DNA, 33 bp, homo sapien
tgagagcagattgaagragccacttatggccaa

SEQ ID NO: 5176 - DNA, 33 bp, homo sapien
cagaactcacatgcaaktattgacatagaggac

SEQ ID NO: 5177 - DNA, 33 bp, homo sapien
tcaagatataatggatwccggaagctttaaaac

SEQ ID NO: 5178 - DNA, 33 bp, homo sapien
atagcaacataatttaycaactcaacattgact

SEQ ID NO: 5179 - DNA, 33 bp, homo sapien
taagcggcctctctcamcttcatactaaaatat

SEQ ID NO: 5180 - DNA, 33 bp, homo sapien
ctctgccgaggtggtcwttatcctgatttctaa

SEQ ID NO: 5181 - DNA, 33 bp, homo sapien
tatttacttagttcttygacgcagagcttttcc

SEQ ID NO: 5182 - DNA, 33 bp, homo sapien
aagaattgtctcaggcygcatataaaatacacc

SEQ ID NO: 5183 - DNA, 33 bp, homo sapien
ggaactggccagtcagrtaagaaatacagtcta

SEQ ID NO: 5184 - DNA, 33 bp, homo sapien
tatagtattaaggatcrtttttgagtattacgg

SEQ ID NO: 5185 - DNA, 33 bp, homo sapien
ttgaggagaagcaaacstgccatcttagaattt

SEQ ID NO: 5186 - DNA, 33 bp, homo sapien
tgatattttgtgctcaygtcctatgtatcatgc

SEQ ID NO: 5187 - DNA, 33 bp, homo sapien
attttattttcagttgmcttctcaattttctat

SEQ ID NO: 5188 - DNA, 33 bp, homo sapien
acaaggattgtgtttgyttttccttgtctgtgt

SEQ ID NO: 5189 - DNA, 33 bp, homo sapien
tctgaactaaacgataygtgttttgcagttttt

SEQ ID NO: 5190 - DNA, 33 bp, homo sapien
aggtagctgccctggcrtatttaacaacatcag

SEQ ID NO: 5191 - DNA, 33 bp, homo sapien
tggaggataaagacagsagttggttagatcaga

SEQ ID NO: 5192 - DNA, 33 bp, homo sapien
actgacctcacattgtyctccttggttacatca

SEQ ID NO: 5193 - DNA, 33 bp, homo sapien
tagaggaacacattttyaactggctgccaagca

SEQ ID NO: 5194 - DNA, 33 bp, homo sapien
aaacaaatttccatacrtgtcaaacaaatgatt

SEQ ID NO: 5195 - DNA, 33 bp, homo sapien
acttctctttggataaygacagtgactaatgct

SEQ ID NO: 5196 - DNA, 33 bp, homo sapien
accccatcgtatcttcstctgtcttactagatg

SEQ ID NO: 5197 - DNA, 33 bp, homo sapien
agagagagtattaaagrgtcttgtcaatgccta

SEQ ID NO: 5198 - DNA, 33 bp, homo sapien
aaagctttctgtgaagwcatactgaagttaagc

SEQ ID NO: 5199 - DNA, 33 bp, homo sapien
acacaatacacttgacygggccaggtcctggga

SEQ ID NO: 5200 - DNA, 33 bp, homo sapien
ttttgctggtaggcctrtaacaagattcaatta

SEQ ID NO: 5201 - DNA, 33 bp, homo sapien
gactgcttgttgcaatmagataaccaatttata

SEQ ID NO: 5202 - DNA, 33 bp, homo sapien
cataggtatctatttcmactaagcaatggtgat

SEQ ID NO: 5203 - DNA, 33 bp, homo sapien
actcacagaagtgtgasctaaaccggtgatggt

SEQ ID NO: 5204 - DNA, 33 bp, homo sapien
ctaagcaagatgatttygggaatgattttttgt

SEQ ID NO: 5205 - DNA, 33 bp, homo sapien
agatacctggctcaatmcattactggaaagagt

SEQ ID NO: 5206 - DNA, 33 bp, homo sapien
agaacctgtggatatgyaccttgtgtggcaaaa

SEQ ID NO: 5207 - DNA, 33 bp, homo sapien
gtgtatattatccatcwttatggcaaagaagta

SEQ ID NO: 5208 - DNA, 33 bp, homo sapien
ctcccagtctcagaaaycatggagccatattgt

SEQ ID NO: 5209 - DNA, 33 bp, homo sapien
ggcaggtgtattagacmaacgagacttaggtaa

SEQ ID NO: 5210 - DNA, 33 bp, homo sapien
aagaatgatattgttcyataacctgttaaagat

SEQ ID NO: 5211 - DNA, 33 bp, homo sapien
gtggttagttgcttagrttgggtcgtgttttcc

SEQ ID NO: 5212 - DNA, 33 bp, homo sapien
tttgggcaaaggaaaascaaatgaagatcaaga

SEQ ID NO: 5213 - DNA, 33 bp, homo sapien
aaccattcatctcagartatgtctggtcactag

SEQ ID NO: 5214 - DNA, 33 bp, homo sapien
gccaatgaaatcacatmaaccttagcacccaga

SEQ ID NO: 5215 - DNA, 33 bp, homo sapien
aagctatgaattagaamcagagtagtcttttat

SEQ ID NO: 5216 - DNA, 33 bp, homo sapien
catgccttggtgtagawaactttttacttactg

SEQ ID NO: 5217 - DNA, 33 bp, homo sapien
tcgctgatattaaatgyagactctgttgaaact

SEQ ID NO: 5218 - DNA, 33 bp, homo sapien
ggggagaaggtgaccastcctcgggaatagagt

SEQ ID NO: 5219 - DNA, 33 bp, homo sapien
cccgattaaactcttamttctttcctctgagta

SEQ ID NO: 5220 - DNA, 33 bp, homo sapien
gtgaatttgacagaggwcttggacagtgtctct

SEQ ID NO: 5221 - DNA, 33 bp, homo sapien
caaagacagaacctggmgaatgaaggtggaaga

SEQ ID NO: 5222 - DNA, 33 bp, homo sapien
tatgtgtcaatccaccrgaatttagggctttct

SEQ ID NO: 5223 - DNA, 33 bp, homo sapien
aataaacataatgggtmaatggtatggtaagtt

SEQ ID NO: 5224 - DNA, 33 bp, homo sapien
agattacaacagaccckataatcctcagaagac

SEQ ID NO: 5225 - DNA, 33 bp, homo sapien
aagcagctactatctgktttttgtctcagttct

SEQ ID NO: 5226 - DNA, 33 bp, homo sapien
ttcttgctgagaggtcrtccttgtttctggcac

SEQ ID NO: 5227 - DNA, 33 bp, homo sapien
gattacattgtgccttktcaacatattagtctg

SEQ ID NO: 5228 - DNA, 33 bp, homo sapien
gttttaagtgaacaagygagattttaatagctc

SEQ ID NO: 5229 - DNA, 33 bp, homo sapien
agggaggaatgacatgygtgacatattcccctt

SEQ ID NO: 5230 - DNA, 33 bp, homo sapien
tccattgtaataaatgyggacagactaggtatt

SEQ ID NO: 5231 - DNA, 33 bp, homo sapien
tgtgctttgatcgatgyggttgttctttcctct

SEQ ID NO: 5232 - DNA, 33 bp, homo sapien
caaccccttcttggagwaaacctgttaatatcc

SEQ ID NO: 5233 - DNA, 33 bp, homo sapien
aaacacaaaggcttcaycggttttggtcacaat

SEQ ID NO: 5234 - DNA, 33 bp, homo sapien
ggtagggctcatcctcrtattttctgttggagc

SEQ ID NO: 5235 - DNA, 33 bp, homo sapien
gtactttatggaaaccrtgacatacactaaaga

SEQ ID NO: 5236 - DNA, 33 bp, homo sapien
aaatatatgaatagtcstaaaatagagggaaat

SEQ ID NO: 5237 - DNA, 33 bp, homo sapien
ctgaaggaacaccacascggtgatcgctttcgt

SEQ ID NO: 5238 - DNA, 33 bp, homo sapien
aaaagtctagggtatayacagtagcattgcttt

SEQ ID NO: 5239 - DNA, 33 bp, homo sapien
cgagtgattgaaggagmatgagaacgagatgga

SEQ ID NO: 5240 - DNA, 33 bp, homo sapien
ccgtgttgaaagtggawccgttagtccattcag

SEQ ID NO: 5241 - DNA, 33 bp, homo sapien
gaagaaggataggaagrgaaaactgcacattaa

SEQ ID NO: 5242 - DNA, 33 bp, homo sapien
ctgcagattgaagtccyggaagaaaaaatgaga

SEQ ID NO: 5243 - DNA, 33 bp, homo sapien
ccaaacagtaaaaataygacctaaaattatctc

SEQ ID NO: 5244 - DNA, 33 bp, homo sapien
tcaggtggcaggagaamagcaagaagacaggat

SEQ ID NO: 5245 - DNA, 33 bp, homo sapien
tgtgctgatggctgtcsaagtggttacggggtc

SEQ ID NO: 5246 - DNA, 33 bp, homo sapien
attttgaaaatcatggktttctctagtgtgccg

SEQ ID NO: 5247 - DNA, 33 bp, homo sapien
atcaggtgtcagacatrcattgcagcatgaagg

SEQ ID NO: 5248 - DNA, 33 bp, homo sapien
tgttatagatctgatcrtgaattctcttagaaa

SEQ ID NO: 5249 - DNA, 33 bp, homo sapien
acttgcttaggagaaarggcaaatttattgctc

SEQ ID NO: 5250 - DNA, 33 bp, homo sapien
agctagggagcgtatcstgggttattcatgtgg

SEQ ID NO: 5251 - DNA, 33 bp, homo sapien
atatgcatgtttctgckaagaactcaagaactc

SEQ ID NO: 5252 - DNA, 33 bp, homo sapien
gtttcaccaaatcctarcagcagaactttgggc

SEQ ID NO: 5253 - DNA, 33 bp, homo sapien
gctgcagggacctttcyggccgctgtgtgccct

SEQ ID NO: 5254 - DNA, 33 bp, homo sapien
agctgcagagtccaagwactgttgatctcaagc

SEQ ID NO: 5255 - DNA, 33 bp, homo sapien
ctgacaggcaccatctyggttagctgtgggacc

SEQ ID NO: 5256 - DNA, 33 bp, homo sapien
ttatataaagaacttaycaacttaactgataaa

SEQ ID NO: 5257 - DNA, 33 bp, homo sapien
tctttatgcatccttarctcaacattattacaa

SEQ ID NO: 5258 - DNA, 33 bp, homo sapien
ctgctgtcattctcgtrcgcctctctagaaggc

SEQ ID NO: 5259 - DNA, 33 bp, homo sapien
aagggagttgaggtgtycagccatcaaaaccca

SEQ ID NO: 5260 - DNA, 33 bp, homo sapien
aagctgagaggtcttgmggatatctagaaaact

SEQ ID NO: 5261 - DNA, 33 bp, homo sapien
ccttgctggcttttccrtttgtcatccattgct

SEQ ID NO: 5262 - DNA, 33 bp, homo sapien
attaaaccaaagagccraagcagtgattatctg

SEQ ID NO: 5263 - DNA, 33 bp, homo sapien
gtaaagcctcactcgcrtatcttacgtagggca

SEQ ID NO: 5264 - DNA, 33 bp, homo sapien
tttctttgacattctamctacaatttcaaaatc

SEQ ID NO: 5265 - DNA, 33 bp, homo sapien
gtaaccgcatcaaaagraaggtgaggccttcct

SEQ ID NO: 5266 - DNA, 33 bp, homo sapien
tgcggagcaattgggcmaaataataatccttga

SEQ ID NO: 5267 - DNA, 33 bp, homo sapien
agagggacacgtactgkctttggctttctgttc

SEQ ID NO: 5268 - DNA, 33 bp, homo sapien
atcccatcaggtgggtyatttgagcccaggagt

SEQ ID NO: 5269 - DNA, 33 bp, homo sapien
agaaaagtctactcgtkgtccctgaaatattct

SEQ ID NO: 5270 - DNA, 33 bp, homo sapien
tgaggataaatcgtgarttggaaggagtccgcc

SEQ ID NO: 5271 - DNA, 33 bp, homo sapien
aattaaaaaatatctcygaaacttcacttagac

SEQ ID NO: 5272 - DNA, 33 bp, homo sapien
agaagtttcagtttcarttcagtttcttttcat

SEQ ID NO: 5273 - DNA, 33 bp, homo sapien
agatgtgctttgtttcrtgtgctgtgcatttca

SEQ ID NO: 5274 - DNA, 33 bp, homo sapien
agtactggtctccttgygtaattgagagtgatg

SEQ ID NO: 5275 - DNA, 33 bp, homo sapien
tcctgtacttcttaaartattactatgcaaagt

SEQ ID NO: 5276 - DNA, 33 bp, homo sapien
aagatttgaaagcttakaccttatgggagctag

SEQ ID NO: 5277 - DNA, 33 bp, homo sapien
ctctcaactttgcagaytcaaataaatccaaat

SEQ ID NO: 5278 - DNA, 33 bp, homo sapien
ttaaaaccttgcctaaygcaaggcaatccgctc

SEQ ID NO: 5279 - DNA, 33 bp, homo sapien
caggcttagcaatgcayattaaagttcaaattc

SEQ ID NO: 5280 - DNA, 33 bp, homo sapien
agtttatcatgctcccrttgtgaacttcatgcc

SEQ ID NO: 5281 - DNA, 33 bp, homo sapien
ttgaacacagtttgaasagttggtcacctttga

SEQ ID NO: 5282 - DNA, 33 bp, homo sapien
tgatggtgtactcacawtcacttaattgccctc

SEQ ID NO: 5283 - DNA, 33 bp, homo sapien
aggccttgcagagaagmctgttcccttcatttc

SEQ ID NO: 5284 - DNA, 33 bp, homo sapien
tccctatgattaatccrtcttctatctacagat

SEQ ID NO: 5285 - DNA, 33 bp, homo sapien
aacatggaaagactagrcttgctgagtcttctg

SEQ ID NO: 5286 - DNA, 33 bp, homo sapien
gcagcacctttccgtgractctaggggaccaaa

SEQ ID NO: 5287 - DNA, 33 bp, homo sapien
attatatccctgtggcrttaacagtgatgatca

SEQ ID NO: 5288 - DNA, 33 bp, homo sapien
aaatcatctcagagccrgaaaagggttttttgt

SEQ ID NO: 5289 - DNA, 33 bp, homo sapien
catgctgtctatctcartgatatacccagttgc

SEQ ID NO: 5290 - DNA, 33 bp, homo sapien
tgtgtgctatagtgtasgtctacatactaaatg

SEQ ID NO: 5291 - DNA, 33 bp, homo sapien
aataaacaatagacctytttggggagcagtttg

SEQ ID NO: 5292 - DNA, 33 bp, homo sapien
aatactcatttctcttyatccaggaaggcaaaa

SEQ ID NO: 5293 - DNA, 33 bp, homo sapien
tgtacatatctaataarcattgatacattttcg

SEQ ID NO: 5294 - DNA, 33 bp, homo sapien
tgtctgcgggacagttragaaaatggaagatga

SEQ ID NO: 5295 - DNA, 33 bp, homo sapien
aaaaaagcacattcaarttaaagagaaaaccta

SEQ ID NO: 5296 - DNA, 33 bp, homo sapien
aaatgttttcgtgcacygctgacatgcacctgt

SEQ ID NO: 5297 - DNA, 33 bp, homo sapien
cagagacagacagagakttaatccagggtaagg

SEQ ID NO: 5298 - DNA, 33 bp, homo sapien
catctgagcccatttcsattagtatctttgata

SEQ ID NO: 5299 - DNA, 33 bp, homo sapien
tctggcctctacctttycaagtgtatggctctt

SEQ ID NO: 5300 - DNA, 33 bp, homo sapien
catgctggcttgactaytgtaactttgtagtaa

SEQ ID NO: 5301 - DNA, 33 bp, homo sapien
ggcctttggactcaggktttatactagcggcct

SEQ ID NO: 5302 - DNA, 33 bp, homo sapien
tattttagatgaaaaayctggcatgcacttgac

SEQ ID NO: 5303 - DNA, 33 bp, homo sapien
ataaaacctggagatgrcaactttaattattag

SEQ ID NO: 5304 - DNA, 33 bp, homo sapien
attatccatcttgttcrttcttctgcttcagga

SEQ ID NO: 5305 - DNA, 33 bp, homo sapien
tttgatacagcaacatractcctgagtgttagc

SEQ ID NO: 5306 - DNA, 33 bp, homo sapien
acctgaattatttcaamaactgcattttccttc

SEQ ID NO: 5307 - DNA, 33 bp, homo sapien
agcttagcaatccaaasagaaaagggagactct

SEQ ID NO: 5308 - DNA, 33 bp, homo sapien
acatacatttgtatttkcagtcttctgctttat

SEQ ID NO: 5309 - DNA, 33 bp, homo sapien
tccttggcattactaaygtctcctttctgatcc

SEQ ID NO: 5310 - DNA, 33 bp, homo sapien
aagaaaaaccatgtagrctttgaaccaggaaaa

SEQ ID NO: 5311 - DNA, 33 bp, homo sapien
gctccagctacaacaayttaaagagattgacag

SEQ ID NO: 5312 - DNA, 33 bp, homo sapien
aaaaaagacagagggakgtttacaaatgcaaaa

SEQ ID NO: 5313 - DNA, 33 bp, homo sapien
tagtaataaagactaartaagtagtgtctgaat

SEQ ID NO: 5314 - DNA, 33 bp, homo sapien
tggaaagctctatagaragtaaaatgtagagga

SEQ ID NO: 5315 - DNA, 33 bp, homo sapien
aaaccagtgtctcatayttcttacctttcccat

SEQ ID NO: 5316 - DNA, 33 bp, homo sapien
cggactgaattatctcraccaaggagattggac

SEQ ID NO: 5317 - DNA, 33 bp, homo sapien
tcccatctttatgccartgtgtgcccaacgttt

SEQ ID NO: 5318 - DNA, 33 bp, homo sapien
acaatcaagtaggaaakgttacagaggctaatg

SEQ ID NO: 5319 - DNA, 33 bp, homo sapien
cttctcaactacttcarttgcctcctacctgtt

SEQ ID NO: 5320 - DNA, 33 bp, homo sapien
atatacctcttattacmacctggaaattaccac

SEQ ID NO: 5321 - DNA, 33 bp, homo sapien
cttcttataaaaatgcyctggagaaattgtctc

SEQ ID NO: 5322 - DNA, 33 bp, homo sapien
tccagttcatttttttycctcaaagctgcactg

SEQ ID NO: 5323 - DNA, 33 bp, homo sapien
tcgtgattggagtcacmatgcatagctgaggat

SEQ ID NO: 5324 - DNA, 33 bp, homo sapien
aaaacatccgtaacttrgcaaaataaaaagctg

SEQ ID NO: 5325 - DNA, 33 bp, homo sapien
tgcctattcactgatgrctgttataattttagg

SEQ ID NO: 5326 - DNA, 33 bp, homo sapien
attacacaaaataaatmactgaagaaatttcta

SEQ ID NO: 5327 - DNA, 33 bp, homo sapien
tactaaaggagaacaaragacaggaataaaaaa

SEQ ID NO: 5328 - DNA, 33 bp, homo sapien
gtagtaacaaacctcawattttcaaagttgaag

SEQ ID NO: 5329 - DNA, 33 bp, homo sapien
cttccccaggagacgayatctgagcatctgaat

SEQ ID NO: 5330 - DNA, 33 bp, homo sapien
ggacaggcacctggcartccaaattgtcctcat

SEQ ID NO: 5331 - DNA, 33 bp, homo sapien
gagattaattttttaayaagtgccgtgatttcc

SEQ ID NO: 5332 - DNA, 33 bp, homo sapien
ctctcgaaactcccacrtgtccttcttttctgg

SEQ ID NO: 5333 - DNA, 33 bp, homo sapien
ttgagcttcatgatctmatacaaatgcactgtt

SEQ ID NO: 5334 - DNA, 33 bp, homo sapien
cagttccaaaaaggttwgaagagatcagcgctg

SEQ ID NO: 5335 - DNA, 33 bp, homo sapien
taaatcctttttatccrgttgttctcaagggat

SEQ ID NO: 5336 - DNA, 33 bp, homo sapien
taaaccagacaaccaaygccaatttttccagtg

SEQ ID NO: 5337 - DNA, 33 bp, homo sapien
gagtcctctttttcccrtacttcatcccagaac

SEQ ID NO: 5338 - DNA, 33 bp, homo sapien
taagttctaagagaaamatgattgtgctataag

SEQ ID NO: 5339 - DNA, 33 bp, homo sapien
cttctaacactgtggcraaataggtggtgttca

SEQ ID NO: 5340 - DNA, 33 bp, homo sapien
actttcttttacaccayttcttggattgcatgc

SEQ ID NO: 5341 - DNA, 33 bp, homo sapien
tttatcttggctttgtrtacttccacggtgtta

SEQ ID NO: 5342 - DNA, 33 bp, homo sapien
cagtaattacctatgtsttttctgcattttctt

SEQ ID NO: 5343 - DNA, 33 bp, homo sapien
tcatttttttgagtgckgatgtaaatgatattg

SEQ ID NO: 5344 - DNA, 33 bp, homo sapien
cttatacctgctaacgsaatctagctaatacct

SEQ ID NO: 5345 - DNA, 33 bp, homo sapien
aaatcacacatgctgaytagttgcttgtgattt

SEQ ID NO: 5346 - DNA, 33 bp, homo sapien
gtaaacagaaacaataygtgcaactccaagtct

SEQ ID NO: 5347 - DNA, 33 bp, homo sapien
tggagagctggaatggyatatgcaagcaactgt

SEQ ID NO: 5348 - DNA, 33 bp, homo sapien
agcactgtggtggattycactgttccttccact

SEQ ID NO: 5349 - DNA, 33 bp, homo sapien
gaggtcccaagaagccragaaatgttactcaaa

SEQ ID NO: 5350 - DNA, 33 bp, homo sapien
tgctgaggagaacaagrcaaagtcctgctctca

SEQ ID NO: 5351 - DNA, 33 bp, homo sapien
aattcttgttgatgacrgtctccaggcccactg

SEQ ID NO: 5352 - DNA, 33 bp, homo sapien
tgaagtcaacatgctcygaatttatgagtatga

SEQ ID NO: 5353 - DNA, 33 bp, homo sapien
aagttcagaggttgccrtctagccttcctcact

SEQ ID NO: 5354 - DNA, 33 bp, homo sapien
tatagcagtagcctgawttctggaatagagtta

SEQ ID NO: 5355 - DNA, 33 bp, homo sapien
ctaattcatcatcggamaatatccaggagccag

SEQ ID NO: 5356 - DNA, 33 bp, homo sapien
tctattataaccagtgrcccttctaagcattca

SEQ ID NO: 5357 - DNA, 33 bp, homo sapien
ttcagtatagtaatctkttacgctctgtatgta

SEQ ID NO: 5358 - DNA, 33 bp, homo sapien
cagtgctgagatgattygatttgcatttgatgg

SEQ ID NO: 5359 - DNA, 33 bp, homo sapien
caactaaaaaattacaygatttgtgcaggcccc

SEQ ID NO: 5360 - DNA, 33 bp, homo sapien
cattcaattgaatatgktcaattggcatcatga

SEQ ID NO: 5361 - DNA, 33 bp, homo sapien
agctccaatgcccagtstctgatgataaggggc

SEQ ID NO: 5362 - DNA, 33 bp, homo sapien
ctgtttcttgttagtgycatcccgtaagctatc

SEQ ID NO: 5363 - DNA, 33 bp, homo sapien
ttctgggtatcatcagktctctcctttggagat

SEQ ID NO: 5364 - DNA, 33 bp, homo sapien
gagacttgaactgacarataagcataacaatag

SEQ ID NO: 5365 - DNA, 33 bp, homo sapien
gagattaaataaagagycgctatgttctaaatg

SEQ ID NO: 5366 - DNA, 33 bp, homo sapien
aaaagagggatatacaytgtagctaaagtgttg

SEQ ID NO: 5367 - DNA, 33 bp, homo sapien
gaggtatttcttgagcygagactttttgtttcc

SEQ ID NO: 5368 - DNA, 33 bp, homo sapien
cacatggtgttgctagmagtattatatcttttg

SEQ ID NO: 5369 - DNA, 33 bp, homo sapien
aatacttatttattctygtggatggtctaatgc

SEQ ID NO: 5370 - DNA, 33 bp, homo sapien
ggcttcgatctggctgmcttctcttcaagcttt

SEQ ID NO: 5371 - DNA, 33 bp, homo sapien
ctcttggacagcagaaygttaatcgacacgcgt

SEQ ID NO: 5372 - DNA, 33 bp, homo sapien
gaataagttgacaaggmtaaacctatcataggt

SEQ ID NO: 5373 - DNA, 33 bp, homo sapien
atgaataaaaatgttcrcgaattaagtgagaga

SEQ ID NO: 5374 - DNA, 33 bp, homo sapien
tttatttggggctgcayctaacttctgccaacc

SEQ ID NO: 5375 - DNA, 33 bp, homo sapien
tgctagaactcacaggrctcaaaaaagctgtta

SEQ ID NO: 5376 - DNA, 33 bp, homo sapien
aggtttgaaagctgtakaaaagtttacataaaa

SEQ ID NO: 5377 - DNA, 33 bp, homo sapien
taggccatgagtaaggygacttgactttgaaag

SEQ ID NO: 5378 - DNA, 33 bp, homo sapien
agagaggcccagtcagktgaaggcaaacacatc

SEQ ID NO: 5379 - DNA, 33 bp, homo sapien
aatcataggttcttccrtttctgttatgaaaga

SEQ ID NO: 5380 - DNA, 33 bp, homo sapien
atcccagaaatgccaayggctacagacaaaaat

SEQ ID NO: 5381 - DNA, 33 bp, homo sapien
caaaaacgtctatactyagcaaaatgacatctt

SEQ ID NO: 5382 - DNA, 33 bp, homo sapien
taggctctatccctctyatttttcaggcagctc

SEQ ID NO: 5383 - DNA, 33 bp, homo sapien
caaaccagttataaccrtgccaagtggagctcc

SEQ ID NO: 5384 - DNA, 33 bp, homo sapien
cacagaacaccctgagwgcattttgagtgggtc

SEQ ID NO: 5385 - DNA, 33 bp, homo sapien
gacctgcttggagatgrtgatgaccttgaggct

SEQ ID NO: 5386 - DNA, 33 bp, homo sapien
aaatcacttatctgtgrcaggtatacccttaca

SEQ ID NO: 5387 - DNA, 33 bp, homo sapien
catatcggccagatttratccaaataaactgaa

SEQ ID NO: 5388 - DNA, 33 bp, homo sapien
aggaatgtaaactggtrcatctattccagaatg

SEQ ID NO: 5389 - DNA, 33 bp, homo sapien
accaacccaaggttackcatctagcaagtggca

SEQ ID NO: 5390 - DNA, 33 bp, homo sapien
ggagtccattatgcttycaaatgcagcacgtaa

SEQ ID NO: 5391 - DNA, 33 bp, homo sapien
ctgtgctgaaagagacrgtgctatctggcccag

SEQ ID NO: 5392 - DNA, 33 bp, homo sapien
gcttatggaaaatgatygtttaaatttagtttt

SEQ ID NO: 5393 - DNA, 33 bp, homo sapien
ccattcctcatgttcakttgatagctgcagtca

SEQ ID NO: 5394 - DNA, 33 bp, homo sapien
aatcttggtcattttgkgttcatttgttgatgg

SEQ ID NO: 5395 - DNA, 33 bp, homo sapien
atgtataggtcatagtsatttgcttcaggtggc

SEQ ID NO: 5396 - DNA, 33 bp, homo sapien
tgtagctgcctacagarttagagaactgcaggt

SEQ ID NO: 5397 - DNA, 33 bp, homo sapien
catcatagccagctacracttgggcagcctttt

SEQ ID NO: 5398 - DNA, 33 bp, homo sapien
atacacttttcttctgkgaaatgctaccctaaa

SEQ ID NO: 5399 - DNA, 33 bp, homo sapien
actagaaacagaaaacrctagtcagccatcttt

SEQ ID NO: 5400 - DNA, 33 bp, homo sapien
gcagaaaagaatctgamgctaggtatgcctgac

SEQ ID NO: 5401 - DNA, 33 bp, homo sapien
cggtttgcacgaacagsatggatttcccctgct

SEQ ID NO: 5402 - DNA, 33 bp, homo sapien
attggtacatgctcaarcattcatccagaatgt

SEQ ID NO: 5403 - DNA, 33 bp, homo sapien
aggttcatagtagacastaagaaaatggagtcg

SEQ ID NO: 5404 - DNA, 33 bp, homo sapien
atacatgtgtgtttagwaggagccttttctttc

SEQ ID NO: 5405 - DNA, 33 bp, homo sapien
gagaagctttccagagyaggtaatgtcagacct

SEQ ID NO: 5406 - DNA, 33 bp, homo sapien
cactaagtgccaggacmtggagaaacaataatg

SEQ ID NO: 5407 - DNA, 33 bp, homo sapien
atcttcttccaatagasggctgtgttgtctaca

SEQ ID NO: 5408 - DNA, 33 bp, homo sapien
ttgtaccagtgtgcaayaggactttggcttatg

SEQ ID NO: 5409 - DNA, 33 bp, homo sapien
tgtagatttgcacgtcygtcttttttcttcctt

SEQ ID NO: 5410 - DNA, 33 bp, homo sapien
ggatgggtattgtaatyggagcagggctgcagc

SEQ ID NO: 5411 - DNA, 33 bp, homo sapien
tgaataaacctgaagartattatgtgaagtgaa

SEQ ID NO: 5412 - DNA, 33 bp, homo sapien
gaatctagcttgcaaawtatcttggtatcttgt

SEQ ID NO: 5413 - DNA, 33 bp, homo sapien
gaaccccaaaatgatcmgataatatttctgtct

SEQ ID NO: 5414 - DNA, 33 bp, homo sapien
ataggtcccgaaatggygactcatgccctctcc

SEQ ID NO: 5415 - DNA, 33 bp, homo sapien
ataaatgtgacactcargttttagcaaacaata

SEQ ID NO: 5416 - DNA, 33 bp, homo sapien
gattttgaagcttgtamcagaaataggataaaa

SEQ ID NO: 5417 - DNA, 33 bp, homo sapien
tgtggattgtgggaccrgagcattcaggacttt

SEQ ID NO: 5418 - DNA, 33 bp, homo sapien
ccactttgattgatggstataatggcattttgg

SEQ ID NO: 5419 - DNA, 33 bp, homo sapien
tgtctcttagtttttgstgctgcttagagaatt

SEQ ID NO: 5420 - DNA, 33 bp, homo sapien
tgtctctagtaagccarttcctctcttgttctc

SEQ ID NO: 5421 - DNA, 33 bp, homo sapien
gaggtggtcaccaggartaagttgtgtaaggca

SEQ ID NO: 5422 - DNA, 33 bp, homo sapien
agtatttacatatatakcacacaatcatgtatg

SEQ ID NO: 5423 - DNA, 33 bp, homo sapien
gaggtagggccttgtaygcctgagctcttttgg

SEQ ID NO: 5424 - DNA, 33 bp, homo sapien
gatgtaggaaaagcaastccattacataggctt

SEQ ID NO: 5425 - DNA, 33 bp, homo sapien
tctctctcatacccagscgaggctttctccctc

SEQ ID NO: 5426 - DNA, 33 bp, homo sapien
agggtgcaggacctaawatggtttttctgtgtc

SEQ ID NO: 5427 - DNA, 33 bp, homo sapien
cattctcctgctcatcrctgaaaagtagactcc

SEQ ID NO: 5428 - DNA, 33 bp, homo sapien
tctcagcttttatttcktctctacaggctgctc

SEQ ID NO: 5429 - DNA, 33 bp, homo sapien
taaatgcagttgtaacraatgacataaaggaga

SEQ ID NO: 5430 - DNA, 33 bp, homo sapien
cttggctgtaggctccwtgaaagggcatccaga

SEQ ID NO: 5431 - DNA, 33 bp, homo sapien
ttagaagttaaattatytgtttatatcatccag

SEQ ID NO: 5432 - DNA, 33 bp, homo sapien
catagacattatagatsacaggcatgttttctt

SEQ ID NO: 5433 - DNA, 33 bp, homo sapien
caatattgtcatcagtyacttggaggacaaatt

SEQ ID NO: 5434 - DNA, 33 bp, homo sapien
gtggctggttctgatgstatactattgttttac

SEQ ID NO: 5435 - DNA, 33 bp, homo sapien
ttcgtaatgacacaaakatgttatctggctttt

SEQ ID NO: 5436 - DNA, 33 bp, homo sapien
tgtgtatcttgctgaarattgacacagaaaaat

SEQ ID NO: 5437 - DNA, 33 bp, homo sapien
tttgtcatgagaaaccytgatagaaggaagaaa

SEQ ID NO: 5438 - DNA, 33 bp, homo sapien
tgatgacttaagtacayttgctttacaggggaa

SEQ ID NO: 5439 - DNA, 33 bp, homo sapien
catgagctcaccaaacrtactaaatgaggtacc

SEQ ID NO: 5440 - DNA, 33 bp, homo sapien
tctgttgatggcttgaycgtggactttccagcc

SEQ ID NO: 5441 - DNA, 33 bp, homo sapien
gaggcaggtagagggaytctcattctggctgca

SEQ ID NO: 5442 - DNA, 33 bp, homo sapien
cgagaaacaaaacttcmtaacaccttggaatgc

SEQ ID NO: 5443 - DNA, 33 bp, homo sapien
gctgaccagaagaattyggctttataggcagag

SEQ ID NO: 5444 - DNA, 33 bp, homo sapien
gccctcctattcctatkcttctacctatggaaa

SEQ ID NO: 5445 - DNA, 33 bp, homo sapien
gcgcttcccactaaccraagattatttaacttt

SEQ ID NO: 5446 - DNA, 33 bp, homo sapien
atttgggacatattggmttaactaacatattaa

SEQ ID NO: 5447 - DNA, 33 bp, homo sapien
caatctaggtgaaagaygggagttcaggcaggt

SEQ ID NO: 5448 - DNA, 33 bp, homo sapien
atgtaagtagtcagacyggaaatgtactataag

SEQ ID NO: 5449 - DNA, 33 bp, homo sapien
tcaatgcctcagctgcrataaaaaagttacaaa

SEQ ID NO: 5450 - DNA, 33 bp, homo sapien
ccaccctcagttccttyttggaaatctttcaga

SEQ ID NO: 5451 - DNA, 33 bp, homo sapien
gagtctttgtccttacrgagtttgtggtctagt

SEQ ID NO: 5452 - DNA, 33 bp, homo sapien
cattcacctgtcgatarcatttgcattgttcct

SEQ ID NO: 5453 - DNA, 33 bp, homo sapien
ggactgcgtaaaattakttttattttgagagga

SEQ ID NO: 5454 - DNA, 33 bp, homo sapien
aaagggaagatgaagayattcaacttgataaac

SEQ ID NO: 5455 - DNA, 33 bp, homo sapien
agctgaatcttgaagtwtgagtaagagtttctg

SEQ ID NO: 5456 - DNA, 33 bp, homo sapien
tgtaaaatggaggcacratggtgagaaagaggt

SEQ ID NO: 5457 - DNA, 33 bp, homo sapien
caggtggaattttcatmctggcatggaaagatg

SEQ ID NO: 5458 - DNA, 33 bp, homo sapien
cttgctggtgggattgracagaaagaagctcag

SEQ ID NO: 5459 - DNA, 33 bp, homo sapien
agtattttctgaacttytgaatgaaataactga

SEQ ID NO: 5460 - DNA, 33 bp, homo sapien
actttaggaacttagastctagttagggaatat

SEQ ID NO: 5461 - DNA, 33 bp, homo sapien
ttcagcctatctcagcycttatcatgccttcct

SEQ ID NO: 5462 - DNA, 33 bp, homo sapien
gggtcattaaaacgtgrttaagtcctgagggca

SEQ ID NO: 5463 - DNA, 33 bp, homo sapien
tgctgggaagatgacartaagtaacaatgaatg

SEQ ID NO: 5464 - DNA, 33 bp, homo sapien
cctccccagagatgatyattgctaacattttca

SEQ ID NO: 5465 - DNA, 33 bp, homo sapien
aatttttgaccgccttkgcttgtagatgtatca

SEQ ID NO: 5466 - DNA, 33 bp, homo sapien
ttgctttatggttaagyatgtggtcaattttag

SEQ ID NO: 5467 - DNA, 33 bp, homo sapien
atgctctgctaatgtgrcatttgtttggtaata

SEQ ID NO: 5468 - DNA, 33 bp, homo sapien
ctgaattactaacatcmcatccatatctatgtt

SEQ ID NO: 5469 - DNA, 33 bp, homo sapien
acagaaaaagggaaaawttaaagcataactcag

SEQ ID NO: 5470 - DNA, 33 bp, homo sapien
acccatgcagtgaatayaaactcattctcagaa

SEQ ID NO: 5471 - DNA, 33 bp, homo sapien
gttgaagaaaatgaatrtaagtgtggtatggga

SEQ ID NO: 5472 - DNA, 33 bp, homo sapien
gacgagtacacacggtmaagtttgagaagctca

SEQ ID NO: 5473 - DNA, 33 bp, homo sapien
aaatctaagttttgaayagaatctaagtgttgg

SEQ ID NO: 5474 - DNA, 33 bp, homo sapien
gaggtaactgaatcatrggaacagacttgctgt

SEQ ID NO: 5475 - DNA, 33 bp, homo sapien
gtcatttggttcacttygctactactgaagcat

SEQ ID NO: 5476 - DNA, 33 bp, homo sapien
ccatcagctttggcacyaaggccagggagcctc

SEQ ID NO: 5477 - DNA, 33 bp, homo sapien
atccctgtttcacatgrcagccctttatacttt

SEQ ID NO: 5478 - DNA, 33 bp, homo sapien
atataatgcaacactgwgttttcctcaaaaggc

SEQ ID NO: 5479 - DNA, 33 bp, homo sapien
catgtatgtcacctctycttgaatgtagagcta

SEQ ID NO: 5480 - DNA, 33 bp, homo sapien
ctgttcatcttgtcacytttttatttagatatg

SEQ ID NO: 5481 - DNA, 33 bp, homo sapien
tagtttatagaccattkaaagatccctgtctca

SEQ ID NO: 5482 - DNA, 33 bp, homo sapien
tattctcagccaggctrcaacaaggagtcttac

SEQ ID NO: 5483 - DNA, 33 bp, homo sapien
tctcaagtgttctcccrtagaaataaaatataa

SEQ ID NO: 5484 - DNA, 33 bp, homo sapien
ctgtgatctgtgcaaarcttctaggagtaccaa

SEQ ID NO: 5485 - DNA, 33 bp, homo sapien
agcagttgagactccawgaactgtcatctacgt

SEQ ID NO: 5486 - DNA, 33 bp, homo sapien
taaaactccatttgaaraaaacaatcattctcc

SEQ ID NO: 5487 - DNA, 33 bp, homo sapien
gggctgtaaagcagaaktattaatttgaccctc

SEQ ID NO: 5488 - DNA, 33 bp, homo sapien
gggactgatctcatttrtctccacattctttgt

SEQ ID NO: 5489 - DNA, 33 bp, homo sapien
ttctagagaggcacttkcaggatctcagccatt

SEQ ID NO: 5490 - DNA, 33 bp, homo sapien
tgtagagattctatcarttgccaagtgcctatc

SEQ ID NO: 5491 - DNA, 33 bp, homo sapien
ttgatactcagatttgrtataagaggacagaag

SEQ ID NO: 5492 - DNA, 33 bp, homo sapien
ttacagcttgtactacracaagattccactcct

SEQ ID NO: 5493 - DNA, 33 bp, homo sapien
ctagtatatagcttatytaggaatactgtttac

SEQ ID NO: 5494 - DNA, 33 bp, homo sapien
agaagtatggacactamccaactctacaactta

SEQ ID NO: 5495 - DNA, 33 bp, homo sapien
atctgtttcagaaaacyggcattctggctgttg

SEQ ID NO: 5496 - DNA, 33 bp, homo sapien
ctcctagtgtgtcagcrtgtgaccttatttgga

SEQ ID NO: 5497 - DNA, 33 bp, homo sapien
gtgtcctggagatcagygtggatgagaactgag

SEQ ID NO: 5498 - DNA, 33 bp, homo sapien
tatacctgaatacatayaccctaataagtgtta

SEQ ID NO: 5499 - DNA, 33 bp, homo sapien
aggaaatggagctgtcytctgacctaccaaaga

SEQ ID NO: 5500 - DNA, 33 bp, homo sapien
cagccagtacatgatawcgcgatttcaaaaaga

SEQ ID NO: 5501 - DNA, 33 bp, homo sapien
agtgcaatgtgaaaagktgggaagacttgcaaa

SEQ ID NO: 5502 - DNA, 33 bp, homo sapien
tcacttagaacttcaayttttgaatctgtaaaa

SEQ ID NO: 5503 - DNA, 33 bp, homo sapien
atataaagtacttgaarccaggacctggaactt

SEQ ID NO: 5504 - DNA, 33 bp, homo sapien
ctaaggacaattagagratgaatgcctaggtcc

SEQ ID NO: 5505 - DNA, 33 bp, homo sapien
gtctggacccagatttygtgccaagaatgggag

SEQ ID NO: 5506 - DNA, 33 bp, homo sapien
tctaactctgaggtttragcactctgcttttag

SEQ ID NO: 5507 - DNA, 33 bp, homo sapien
agtcctccaggggccartgtcagaacatgggta

SEQ ID NO: 5508 - DNA, 33 bp, homo sapien
ctctgactctgctcctyctcactgttgctttgc

SEQ ID NO: 5509 - DNA, 33 bp, homo sapien
aattgtaatttgcacaygtggagggagggacct

SEQ ID NO: 5510 - DNA, 33 bp, homo sapien
actccagaggccagctmagctcaatctgggcag

SEQ ID NO: 5511 - DNA, 33 bp, homo sapien
aagttgagactagctgrtacagttaagcctaag

SEQ ID NO: 5512 - DNA, 33 bp, homo sapien
tcacctgactgctcacytttaccctacctgcct

SEQ ID NO: 5513 - DNA, 33 bp, homo sapien
ggcctctacccacaatygattccttctccaatt

SEQ ID NO: 5514 - DNA, 33 bp, homo sapien
atgtcccaatggaaggyggacagcggccatctt

SEQ ID NO: 5515 - DNA, 33 bp, homo sapien
agagctggaagctggcyatttgggtgtgagtat

SEQ ID NO: 5516 - DNA, 33 bp, homo sapien
ggcatgtcatggatgcktgtacagggttggctg

SEQ ID NO: 5517 - DNA, 33 bp, homo sapien
tccaaagtggtcctccrtgatctccacatcctg

SEQ ID NO: 5518 - DNA, 33 bp, homo sapien
tttacttatctgatctrtacgtaaccaatctct

SEQ ID NO: 5519 - DNA, 33 bp, homo sapien
aggaaacgggcacgtcmatgagtggctggcatg

SEQ ID NO: 5520 - DNA, 33 bp, homo sapien
gatgtactaggtactayggaggagacaacaaat

SEQ ID NO: 5521 - DNA, 33 bp, homo sapien
gctcaccactggcttargaaactcccgggaggc

SEQ ID NO: 5522 - DNA, 33 bp, homo sapien
ggacatctagctcactrtgttctccatggggga

SEQ ID NO: 5523 - DNA, 33 bp, homo sapien
gttgtagccacattacrcctttgcattactctt

SEQ ID NO: 5524 - DNA, 33 bp, homo sapien
gtgaactagggcttgaratagatctttctatat

SEQ ID NO: 5525 - DNA, 33 bp, homo sapien
aatccatgacgcttgtragtggagctatttttc

SEQ ID NO: 5526 - DNA, 33 bp, homo sapien
tattttgttttcttaayatttgtgtattcactg

SEQ ID NO: 5527 - DNA, 33 bp, homo sapien
tcttgataaagtgtctmtcaagtgcatgagcga

SEQ ID NO: 5528 - DNA, 33 bp, homo sapien
atctcaggatcacacarcattctaggttcatgg

SEQ ID NO: 5529 - DNA, 33 bp, homo sapien
ctgaattctatcagacrttcaaaagagaattgg

SEQ ID NO: 5530 - DNA, 33 bp, homo sapien
ttttcctttagctaaakcctattctatgaactt

SEQ ID NO: 5531 - DNA, 33 bp, homo sapien
ctagggacctgagttgraatcccagttctgcta

SEQ ID NO: 5532 - DNA, 33 bp, homo sapien
ggaaccaccgatattcrtgagatatgccatata

SEQ ID NO: 5533 - DNA, 33 bp, homo sapien
acgaagtagccagggayatttgtctttctatca

SEQ ID NO: 5534 - DNA, 33 bp, homo sapien
tctttgtggcagtgacwtgttgaagaaactgga

SEQ ID NO: 5535 - DNA, 33 bp, homo sapien
gcttatgaaagaccccrttcaatatccgggttt

SEQ ID NO: 5536 - DNA, 33 bp, homo sapien
tggtgtatagcagtgcwgttaatttgtgtacat

SEQ ID NO: 5537 - DNA, 33 bp, homo sapien
gcagcttctctaacttmttttgttaatagaggc

SEQ ID NO: 5538 - DNA, 33 bp, homo sapien
agtcttgcttcctacarggtctggtgacttaat

SEQ ID NO: 5539 - DNA, 33 bp, homo sapien
attctttgctcttggaktttttaagataatttt

SEQ ID NO: 5540 - DNA, 33 bp, homo sapien
cccagagatgatttgarcagccatgccaattag

SEQ ID NO: 5541 - DNA, 33 bp, homo sapien
taaagcttaatagccartgtgacagtattaaga

SEQ ID NO: 5542 - DNA, 33 bp, homo sapien
ctactaaagttcagatwgatcttaccaaactgt

SEQ ID NO: 5543 - DNA, 33 bp, homo sapien
ggacaatgccttgccartattgaaataaaattg

SEQ ID NO: 5544 - DNA, 33 bp, homo sapien
cttcaacctcactcttyacatgaagaattccaa

SEQ ID NO: 5545 - DNA, 33 bp, homo sapien
gtaaccccagctacacyattattatgttttaaa

SEQ ID NO: 5546 - DNA, 33 bp, homo sapien
tctgtcaggaacctggrcagtgataggactagc

SEQ ID NO: 5547 - DNA, 33 bp, homo sapien
atgactccaaaattacrccctatgctgtgatgg

SEQ ID NO: 5548 - DNA, 33 bp, homo sapien
ttggagactttgatttsctaatatgggatggag

SEQ ID NO: 5549 - DNA, 33 bp, homo sapien
ccagaaataaactcacrtatacggaaatgtatt

SEQ ID NO: 5550 - DNA, 33 bp, homo sapien
aatgacttgccattggyagataaaaaattagga

SEQ ID NO: 5551 - DNA, 33 bp, homo sapien
aagctgaaggtttaggraagaaccatctgagag

SEQ ID NO: 5552 - DNA, 33 bp, homo sapien
gaaacattttgccactrtcttcttaggatacat

SEQ ID NO: 5553 - DNA, 33 bp, homo sapien
agcttgctttgactaayagaatatcataaaagt

SEQ ID NO: 5554 - DNA, 33 bp, homo sapien
tgttgtccaatacggtrtccaccagccatatgg

SEQ ID NO: 5555 - DNA, 33 bp, homo sapien
acaagctataaaccaamgaagcatctacagagc

SEQ ID NO: 5556 - DNA, 33 bp, homo sapien
ttgagcaatggccctckttaattttatcagata

SEQ ID NO: 5557 - DNA, 33 bp, homo sapien
ttgggataggattgctragcttgatgaattagc

SEQ ID NO: 5558 - DNA, 33 bp, homo sapien
ttgccaggtggactgaygctgatttccaagatt

SEQ ID NO: 5559 - DNA, 33 bp, homo sapien
ctaatagcttatgatgrtgcctagagattatag

SEQ ID NO: 5560 - DNA, 33 bp, homo sapien
gattgtcctttattccrtattaaaacatttccc

SEQ ID NO: 5561 - DNA, 33 bp, homo sapien
aacctacataatctgcytactatcagcactccc

SEQ ID NO: 5562 - DNA, 33 bp, homo sapien
gagagtagagtccagayataaattcatgcctat

SEQ ID NO: 5563 - DNA, 33 bp, homo sapien
tgaaactaagggcacaytggtttctggaaaggt

SEQ ID NO: 5564 - DNA, 33 bp, homo sapien
tttttgctaagcgtcartaaacagcatcctcaa

SEQ ID NO: 5565 - DNA, 33 bp, homo sapien
agttggaggtatgtacwcattttcccagtgaat

SEQ ID NO: 5566 - DNA, 33 bp, homo sapien
tgtaagcaagctgtaarccctctgagaacagga

SEQ ID NO: 5567 - DNA, 33 bp, homo sapien
aatagagaccacaggtyataagaaaaagttatg

SEQ ID NO: 5568 - DNA, 33 bp, homo sapien
tatcttttcatatgctyacatgacatctgtgta

SEQ ID NO: 5569 - DNA, 33 bp, homo sapien
agaggccatgttgaggyttccacaacagagaaa

SEQ ID NO: 5570 - DNA, 33 bp, homo sapien
ctcagtagattcccagrtccagggctgcagctc

SEQ ID NO: 5571 - DNA, 33 bp, homo sapien
tgaaatctacctaaacrttcattgccaagagta

SEQ ID NO: 5572 - DNA, 33 bp, homo sapien
atggcttgctgcaggcrtgaagagacaggtcag

SEQ ID NO: 5573 - DNA, 33 bp, homo sapien
tggaaaactagccattrattttagaaagagctt

SEQ ID NO: 5574 - DNA, 33 bp, homo sapien
cccattaataaatttcytatcatttacacctac

SEQ ID NO: 5575 - DNA, 33 bp, homo sapien
tatcagaaacagcaagmcttctttcctctctaa

SEQ ID NO: 5576 - DNA, 33 bp, homo sapien
ctggtgaaaaacaaacrtcatgctcaaatgagg

SEQ ID NO: 5577 - DNA, 33 bp, homo sapien
atgccaaaggacagtgwggccataaaatgttta

SEQ ID NO: 5578 - DNA, 33 bp, homo sapien
tgggagctgtgcccagrtccgagccagagaaaa

SEQ ID NO: 5579 - DNA, 33 bp, homo sapien
agcagacctcctgtgtrtccttcaccactttct

SEQ ID NO: 5580 - DNA, 33 bp, homo sapien
tcctaagtctctccctrtgtgtcagcctccatg

SEQ ID NO: 5581 - DNA, 33 bp, homo sapien
gaagctggggtggatgygaacatgaaaagcaaa

SEQ ID NO: 5582 - DNA, 33 bp, homo sapien
tactatgatcatctggycaattctataggtatc

SEQ ID NO: 5583 - DNA, 33 bp, homo sapien
aaattgtatggatttartgtaagtcttgggatc

SEQ ID NO: 5584 - DNA, 33 bp, homo sapien
ccaacatcttaactcaytacagcttcaagtcca

SEQ ID NO: 5585 - DNA, 33 bp, homo sapien
ggtctcttggagtaaaygatttttgcaggatag

SEQ ID NO: 5586 - DNA, 33 bp, homo sapien
caacttggggtggttgsccagctcattagccac

SEQ ID NO: 5587 - DNA, 33 bp, homo sapien
taaatactctggctgtractcactgaaactaac

SEQ ID NO: 5588 - DNA, 33 bp, homo sapien
gccttgttaccaatctkatgaggaaagcattta

SEQ ID NO: 5589 - DNA, 33 bp, homo sapien
cagatagtaaagaataygagtaaacataaaatg

SEQ ID NO: 5590 - DNA, 33 bp, homo sapien
cggctgtactggatctmatcttatttatgcaaa

SEQ ID NO: 5591 - DNA, 33 bp, homo sapien
ttaagacagtgcccatrgacggccataatccca

SEQ ID NO: 5592 - DNA, 33 bp, homo sapien
gaaccttggctccctgytcatatttaagagaat

SEQ ID NO: 5593 - DNA, 33 bp, homo sapien
gcctcctgcatgcttcrtcacatagccaccttc

SEQ ID NO: 5594 - DNA, 33 bp, homo sapien
cagcaccaaaaatcgartgtagctctgattgcc

SEQ ID NO: 5595 - DNA, 33 bp, homo sapien
ctctttggtgccaggawccaaaccaaggcctgc

SEQ ID NO: 5596 - DNA, 33 bp, homo sapien
agtcaggaatgacttgmgtagtcaaagggcatg

SEQ ID NO: 5597 - DNA, 33 bp, homo sapien
ctcgagcatttctgacmcacagtaggtgctcaa

SEQ ID NO: 5598 - DNA, 33 bp, homo sapien
tgacgaggttctccacrgctgcctgcgaccttc

SEQ ID NO: 5599 - DNA, 33 bp, homo sapien
gtagaggtaatccttgytgctggacccaaaaat

SEQ ID NO: 5600 - DNA, 33 bp, homo sapien
agggggccacattgaaygggttcatctgaaatt

SEQ ID NO: 5601 - DNA, 33 bp, homo sapien
tatctcaaaggtgcaaytgaagatcatcgtgga

SEQ ID NO: 5602 - DNA, 33 bp, homo sapien
gacctgttttagcattmttatgtattatctgtt

SEQ ID NO: 5603 - DNA, 33 bp, homo sapien
caggaagtgttggattyagacacgcatgctgga

SEQ ID NO: 5604 - DNA, 33 bp, homo sapien
tcctcaaccttgatcayatctgaaaaatctttc

SEQ ID NO: 5605 - DNA, 33 bp, homo sapien
gaactattaacttaccyaatccttacaaccact

SEQ ID NO: 5606 - DNA, 33 bp, homo sapien
caactattatggactaracattgggtcaagcag

SEQ ID NO: 5607 - DNA, 33 bp, homo sapien
tgtcatggagctagtgsagtagacagaccattc

SEQ ID NO: 5608 - DNA, 33 bp, homo sapien
aaactgcacacttgttwccctaacactactctg

SEQ ID NO: 5609 - DNA, 33 bp, homo sapien
ttggagctcaaggataragaggagaattgctgt

SEQ ID NO: 5610 - DNA, 33 bp, homo sapien
gctaacaataaatgtgytacttggaatttgcta

SEQ ID NO: 5611 - DNA, 33 bp, homo sapien
tgggagtttgtagaaayacctagatttgcaggg

SEQ ID NO: 5612 - DNA, 33 bp, homo sapien
tagccagttggtcaacrtgcagatgactagaaa

SEQ ID NO: 5613 - DNA, 33 bp, homo sapien
atttgtgtatagccagyaggatgaatttaaact

SEQ ID NO: 5614 - DNA, 33 bp, homo sapien
ttttacattgaaatctrtaacccattttgagtt

SEQ ID NO: 5615 - DNA, 33 bp, homo sapien
gcacagcttgtggctcsaaaaaagactccttcc

SEQ ID NO: 5616 - DNA, 33 bp, homo sapien
caagaatgaaaagtcargtgctgaatgggagaa

SEQ ID NO: 5617 - DNA, 33 bp, homo sapien
ggacacctggcttctarttcacccacactgcat

SEQ ID NO: 5618 - DNA, 33 bp, homo sapien
aacagtgggtctctcaytcactgccttgaaaga

SEQ ID NO: 5619 - DNA, 33 bp, homo sapien
tgagactctcagaactrgtttattcaattattt

SEQ ID NO: 5620 - DNA, 33 bp, homo sapien
acctcctgcactagacyaactgtaagagtgaga

SEQ ID NO: 5621 - DNA, 33 bp, homo sapien
cagttccaccaatagcktgtgaatggaagtgat

SEQ ID NO: 5622 - DNA, 33 bp, homo sapien
gaagtgtctggtttctrtcacttagcaccatgc

SEQ ID NO: 5623 - DNA, 33 bp, homo sapien
agctagaggcaaaatarcttgagatacttttgg

SEQ ID NO: 5624 - DNA, 33 bp, homo sapien
ctctaaacctcaatctycctgttatagaaagtg

SEQ ID NO: 5625 - DNA, 33 bp, homo sapien
ggacttactggttttcrggacagtgtcctattt

SEQ ID NO: 5626 - DNA, 33 bp, homo sapien
agcccgtggtgctcacyttccagcaccagctac

SEQ ID NO: 5627 - DNA, 33 bp, homo sapien
ctcaaaccaatttgggycagatttctgtgactt

SEQ ID NO: 5628 - DNA, 33 bp, homo sapien
cagtgaaggccagactkaagaggtcacagatgg

SEQ ID NO: 5629 - DNA, 33 bp, homo sapien
ctttcaattatgaaatytgtggagcttgacaaa

SEQ ID NO: 5630 - DNA, 33 bp, homo sapien
gttagattatgtggtcrgtgatccaggaagcag

SEQ ID NO: 5631 - DNA, 33 bp, homo sapien
atagtctttttcacagmacagttgcttagttct

SEQ ID NO: 5632 - DNA, 33 bp, homo sapien
ttctagttaaatataaygttgaatttcagttat

SEQ ID NO: 5633 - DNA, 33 bp, homo sapien
ctcacttctgattttgyatttcatttccctttt

SEQ ID NO: 5634 - DNA, 33 bp, homo sapien
caaaatgttctatactyacacaaatttattcta

SEQ ID NO: 5635 - DNA, 33 bp, homo sapien
aaaatccaaccaaccayaaaattccacagaaac

SEQ ID NO: 5636 - DNA, 33 bp, homo sapien
caaggattcgggcatamcagattaaatatattt

SEQ ID NO: 5637 - DNA, 33 bp, homo sapien
tgtcttctacaatattytatgtcatctagacca

SEQ ID NO: 5638 - DNA, 33 bp, homo sapien
aacaccaagtaattgcrgcaatgccacagcaga

SEQ ID NO: 5639 - DNA, 33 bp, homo sapien
tttgaagaaggtattcygctgtttactgaaaac

SEQ ID NO: 5640 - DNA, 33 bp, homo sapien
gcatggcagtccagcaytctctaacagaccctg

SEQ ID NO: 5641 - DNA, 33 bp, homo sapien
atttttaaatcacatawgctcctcctctattgt

SEQ ID NO: 5642 - DNA, 33 bp, homo sapien
gtcagcacagaaaaaaytaccatttataaaacc

SEQ ID NO: 5643 - DNA, 33 bp, homo sapien
agggctgccagaagggyttctccaggaatgctc

SEQ ID NO: 5644 - DNA, 33 bp, homo sapien
ttgagcatctttataayagtgtcttattttact

SEQ ID NO: 5645 - DNA, 33 bp, homo sapien
aagtttctagtagtatraagttcccaggccagg

SEQ ID NO: 5646 - DNA, 33 bp, homo sapien
catttcatggagatttktgagtaacagggcata

SEQ ID NO: 5647 - DNA, 33 bp, homo sapien
aatacgttttatgcacsgaacttactgcacatc

SEQ ID NO: 5648 - DNA, 33 bp, homo sapien
tctaaaatttgttataygcacaattctatgaat

SEQ ID NO: 5649 - DNA, 33 bp, homo sapien
tagtctgcaaagaggarcattgccaaattctag

SEQ ID NO: 5650 - DNA, 33 bp, homo sapien
tttgcatttctgtgggktgaatggtaatgtcgc

SEQ ID NO: 5651 - DNA, 33 bp, homo sapien
aataactgaaataaaamtctcaatgaatgggct

SEQ ID NO: 5652 - DNA, 33 bp, homo sapien
gaaggcaagaggacatrgtaggtacacaatata

SEQ ID NO: 5653 - DNA, 33 bp, homo sapien
agagaaagcacagtgcmtttgagtaactgaaat

SEQ ID NO: 5654 - DNA, 33 bp, homo sapien
gccaatgcaaactgacwggcttgaataaagaat

SEQ ID NO: 5655 - DNA, 33 bp, homo sapien
gactagcagatcaaaarcatcccgattcccccc

SEQ ID NO: 5656 - DNA, 33 bp, homo sapien
tttcttcaggttatgtsagtttatttggaagca

SEQ ID NO: 5657 - DNA, 33 bp, homo sapien
aaaatgttcttcaggcmtaataggtgcagttca

SEQ ID NO: 5658 - DNA, 33 bp, homo sapien
acgcggaccgtaaagargtgccagggagctctg

SEQ ID NO: 5659 - DNA, 33 bp, homo sapien
gcctgacatggtcttcyttccggaacataatct

SEQ ID NO: 5660 - DNA, 33 bp, homo sapien
gccatgggtatgttcaygatatcactgattctt

SEQ ID NO: 5661 - DNA, 33 bp, homo sapien
ggtcttctttgactgcraatcttgccatgttca

SEQ ID NO: 5662 - DNA, 33 bp, homo sapien
gtggccaaattgttaarttgcagctttcaagga

SEQ ID NO: 5663 - DNA, 33 bp, homo sapien
aaggcagcagcacaaayagatgggtgggtgaat

SEQ ID NO: 5664 - DNA, 33 bp, homo sapien
gctcaaaaaagcacagmtagtcctctgaattgt

SEQ ID NO: 5665 - DNA, 33 bp, homo sapien
cagataagttagctacycaatgacaaggttaag

SEQ ID NO: 5666 - DNA, 33 bp, homo sapien
gtaagagcataagatcrtttttcagtagttcct

SEQ ID NO: 5667 - DNA, 33 bp, homo sapien
atcaggttggaagttgstatcttattgccataa

SEQ ID NO: 5668 - DNA, 33 bp, homo sapien
ttcatgaatcatctttygctcaaataaattctg

SEQ ID NO: 5669 - DNA, 33 bp, homo sapien
aacatagaaagcctcakcaaagaaatagaagct

SEQ ID NO: 5670 - DNA, 33 bp, homo sapien
taatgccctcctctttwgtttagtgtgttgtct

SEQ ID NO: 5671 - DNA, 33 bp, homo sapien
aaaaaagatacatttgrattttataccacacac

SEQ ID NO: 5672 - DNA, 33 bp, homo sapien
tcacaaagatggaatgratatggtttctgccgt

SEQ ID NO: 5673 - DNA, 33 bp, homo sapien
ccactaggggtcttaarcttgctaggataagaa

SEQ ID NO: 5674 - DNA, 33 bp, homo sapien
aatcagaacatctcttyttgttctcatggttta

SEQ ID NO: 5675 - DNA, 33 bp, homo sapien
tctgtacatcctcattsagaagcagtcattcta

SEQ ID NO: 5676 - DNA, 33 bp, homo sapien
cactccaactcaaaackagaagaagcttctgtg

SEQ ID NO: 5677 - DNA, 33 bp, homo sapien
tttaaaatgtggctagwgttactggaaaacaaa

SEQ ID NO: 5678 - DNA, 33 bp, homo sapien
tagcatttgaatatgastggtatggtcctccag

SEQ ID NO: 5679 - DNA, 33 bp, homo sapien
ttcaagcttttgctatkaggcaataacactact

SEQ ID NO: 5680 - DNA, 33 bp, homo sapien
ttaagcctggtgacatktttaaaccccagaaca

SEQ ID NO: 5681 - DNA, 33 bp, homo sapien
ataataaactggtaacygtaagtaaatgtttcc

SEQ ID NO: 5682 - DNA, 33 bp, homo sapien
atgaacattgacaaaaygcagaaggggtactct

SEQ ID NO: 5683 - DNA, 33 bp, homo sapien
acacagtcaaatacctyaaatgtctatcagtca

SEQ ID NO: 5684 - DNA, 33 bp, homo sapien
tcccaggacagctgccrgtagtgccctctgcct

SEQ ID NO: 5685 - DNA, 33 bp, homo sapien
caggaacacaaaatgcwgatgtgggactagagg

SEQ ID NO: 5686 - DNA, 33 bp, homo sapien
cttccttcagttcctgyttttgaacaaatgtat

SEQ ID NO: 5687 - DNA, 33 bp, homo sapien
gagaaggacagctagtkaagtaggaagagaatg

SEQ ID NO: 5688 - DNA, 33 bp, homo sapien
actcccttcttccgttrtcaaaactagcaatag

SEQ ID NO: 5689 - DNA, 33 bp, homo sapien
aatgtcttccaattgcwgcaattcggttcagtg

SEQ ID NO: 5690 - DNA, 33 bp, homo sapien
gaatgacacgggactcygccatcaagcgtggca

SEQ ID NO: 5691 - DNA, 33 bp, homo sapien
caatgatttccattgcrtttagagaacatccaa

SEQ ID NO: 5692 - DNA, 33 bp, homo sapien
tggcaaaatgttttggratacgactcttgggct

SEQ ID NO: 5693 - DNA, 33 bp, homo sapien
agtgatgtgtttgcacwcttaaatggctactct

SEQ ID NO: 5694 - DNA, 33 bp, homo sapien
aatgaagaacagaatayggcactagatttcctc

SEQ ID NO: 5695 - DNA, 33 bp, homo sapien
gaatctggggttctttsgttctgaaacagctag

SEQ ID NO: 5696 - DNA, 33 bp, homo sapien
aaataatgagataaacratgtctcttacttgaa

SEQ ID NO: 5697 - DNA, 33 bp, homo sapien
caagctacaaaattgaygaattccttcacaaac

SEQ ID NO: 5698 - DNA, 33 bp, homo sapien
gacactaccaatgggcygaatggggcaggcaca

SEQ ID NO: 5699 - DNA, 33 bp, homo sapien
gtgtgtaaacactctcmatttcccagatttaaa

SEQ ID NO: 5700 - DNA, 33 bp, homo sapien
ttttcatggattttaartgtaaatgacctctag

SEQ ID NO: 5701 - DNA, 33 bp, homo sapien
tcttcacaggaagcagsgtgtgtgccttacaag

SEQ ID NO: 5702 - DNA, 33 bp, homo sapien
tcctctctttggacttyagaagcaatccttggg

SEQ ID NO: 5703 - DNA, 33 bp, homo sapien
tgaatatttgacatggraagtctaggtatttta

SEQ ID NO: 5704 - DNA, 33 bp, homo sapien
ctgcataatctgccacrtaattaaaagtaggta

SEQ ID NO: 5705 - DNA, 33 bp, homo sapien
gtacttctttgctccayagctactaagcaatag

SEQ ID NO: 5706 - DNA, 33 bp, homo sapien
agcctgcctgccctggsttagagtcccagctcc

SEQ ID NO: 5707 - DNA, 33 bp, homo sapien
gtaccctcttgccaagkttgatggatatatctg

SEQ ID NO: 5708 - DNA, 33 bp, homo sapien
gtctcgggtgaaggacrattattttttagacaa

SEQ ID NO: 5709 - DNA, 33 bp, homo sapien
tacagagactacgtggrcagcaaatctagaata

SEQ ID NO: 5710 - DNA, 33 bp, homo sapien
cttgaatttctcttccygggtgcgattccttcc

SEQ ID NO: 5711 - DNA, 33 bp, homo sapien
gtttttctgtacatcakgaagtataacaagtgg

SEQ ID NO: 5712 - DNA, 33 bp, homo sapien
aagccatgaataaaacygttctcaggatgcagt

SEQ ID NO: 5713 - DNA, 33 bp, homo sapien
ggttccaaaggatggakaaaacagatctgattt

SEQ ID NO: 5714 - DNA, 33 bp, homo sapien
gctgggtttggtcacaygagttatagctatttc

SEQ ID NO: 5715 - DNA, 33 bp, homo sapien
tttggatgtatttatayggcaccctctcatgcc

SEQ ID NO: 5716 - DNA, 33 bp, homo sapien
ctgggtggaatgattgmgtaaaagtgatttttc

SEQ ID NO: 5717 - DNA, 33 bp, homo sapien
caaggatccagaagtgygcatgcagattttatt

SEQ ID NO: 5718 - DNA, 33 bp, homo sapien
taagatttcacaaatgytacctgtgtatgtcca

SEQ ID NO: 5719 - DNA, 33 bp, homo sapien
tagtgggaagccattgstgcattttaaatgtga

SEQ ID NO: 5720 - DNA, 33 bp, homo sapien
aagtgatcattttgcarctcctaacaacaacga

SEQ ID NO: 5721 - DNA, 33 bp, homo sapien
tattgcaaaagcaacartatcaaagaatgcttt

SEQ ID NO: 5722 - DNA, 33 bp, homo sapien
ttaaaaaatgttgcaayaatgaataactgaatg

SEQ ID NO: 5723 - DNA, 33 bp, homo sapien
ggctacccagaaacagktggcatctttggtagt

SEQ ID NO: 5724 - DNA, 33 bp, homo sapien
tgggattctagcctctygtctttcattaaacct

SEQ ID NO: 5725 - DNA, 33 bp, homo sapien
gcactcttaatgcagcratctcaggctttattt

SEQ ID NO: 5726 - DNA, 33 bp, homo sapien
ggacaaaaataatgtcytggaatttgttagatc

SEQ ID NO: 5727 - DNA, 33 bp, homo sapien
agcaaggctctgtgggyataggacccgccaagc

SEQ ID NO: 5728 - DNA, 33 bp, homo sapien
attttgatcacatgaarcactttatttattaca

SEQ ID NO: 5729 - DNA, 33 bp, homo sapien
catgcccagcttctacygtctgtttttgtgcat

SEQ ID NO: 5730 - DNA, 33 bp, homo sapien
ggcaggtctgcgatggyggcaaacagcagtggt

SEQ ID NO: 5731 - DNA, 33 bp, homo sapien
tctaaaggaatcaaacwaatccaattgcaaata

SEQ ID NO: 5732 - DNA, 33 bp, homo sapien
gctaggttcttgccctrtatgtgtgacttcagg

SEQ ID NO: 5733 - DNA, 33 bp, homo sapien
catcccaattctaccaygtcaatattatctaga

SEQ ID NO: 5734 - DNA, 33 bp, homo sapien
ggccatcctctttaatrctgaattatgccacag

SEQ ID NO: 5735 - DNA, 33 bp, homo sapien
ctgatcaaatgttcaamgcgcttgcaacctgct

SEQ ID NO: 5736 - DNA, 33 bp, homo sapien
ataccaaattctgacartgcaagttcaaaaagg

SEQ ID NO: 5737 - DNA, 33 bp, homo sapien
tgtctcttttttttgarcaactacctttgtcaa

SEQ ID NO: 5738 - DNA, 33 bp, homo sapien
ggtttagttttgtagcrtaactagaagtcaggg

SEQ ID NO: 5739 - DNA, 33 bp, homo sapien
taacacaaaattatgtrtagttcctgacttctg

SEQ ID NO: 5740 - DNA, 33 bp, homo sapien
gccagaaaataagggasaaatattgcatgcctc

SEQ ID NO: 5741 - DNA, 33 bp, homo sapien
gagatcacacaggccawctcctccattgtacag

SEQ ID NO: 5742 - DNA, 33 bp, homo sapien
tttgttttatttattgsagtatatttttgaagt

SEQ ID NO: 5743 - DNA, 33 bp, homo sapien
aagttgactttaagatygcataatgcatctgat

SEQ ID NO: 5744 - DNA, 33 bp, homo sapien
attttattgtctcttcycatacctcttatccat

SEQ ID NO: 5745 - DNA, 33 bp, homo sapien
acttatttgaatagccsgaagtggcggaagatg

SEQ ID NO: 5746 - DNA, 33 bp, homo sapien
tccttgattagattcakataatttttgtctttt

SEQ ID NO: 5747 - DNA, 33 bp, homo sapien
gacaaattatcacacayttagcagatgaaaaca

SEQ ID NO: 5748 - DNA, 33 bp, homo sapien
agaacttcttgttaaaygctaatctcccacaca

SEQ ID NO: 5749 - DNA, 33 bp, homo sapien
atgagcatgatgacaarttaacacctaaaactg

SEQ ID NO: 5750 - DNA, 33 bp, homo sapien
cctgtagggtggccaayttgtcccagttttcct

SEQ ID NO: 5751 - DNA, 33 bp, homo sapien
gtgcaaaagttgcccaraatttgcatgtgcagt

SEQ ID NO: 5752 - DNA, 33 bp, homo sapien
tggttaagccagaggcycagtgaagttatcgca

SEQ ID NO: 5753 - DNA, 33 bp, homo sapien
tttctatccagctgttmtttttgtatgtgggaa

SEQ ID NO: 5754 - DNA, 33 bp, homo sapien
gacaatatccagggttmcttctagccctcgaat

SEQ ID NO: 5755 - DNA, 33 bp, homo sapien
ggacatggttacctacrtatcagtttttcctcc

SEQ ID NO: 5756 - DNA, 33 bp, homo sapien
aggctacaccacacccyttgctgaatgaggcac

SEQ ID NO: 5757 - DNA, 33 bp, homo sapien
gactttgccgacagacmattttaaatagctgtt

SEQ ID NO: 5758 - DNA, 33 bp, homo sapien
tttgtttttctcctgartgaaaccaccatgccc

SEQ ID NO: 5759 - DNA, 33 bp, homo sapien
tgcaacccaggtcttgyatctgccaccggccaa

SEQ ID NO: 5760 - DNA, 33 bp, homo sapien
gcacagaatgacatggwtaaatctcaaaatgat

SEQ ID NO: 5761 - DNA, 33 bp, homo sapien
gcaatgtgttggtgatyatacaaagctggtata

SEQ ID NO: 5762 - DNA, 33 bp, homo sapien
tacctggactgctgttyccccagatagcattgt

SEQ ID NO: 5763 - DNA, 33 bp, homo sapien
cctgagactgaggccasaaagttaactgtatgt

SEQ ID NO: 5764 - DNA, 33 bp, homo sapien
atgagttctgaactcaragatgacatctggtgt

SEQ ID NO: 5765 - DNA, 33 bp, homo sapien
aacagtatgaagcttcycaaagttttaagtggg

SEQ ID NO: 5766 - DNA, 33 bp, homo sapien
agtatgcctagcaatargagataaacttctact

SEQ ID NO: 5767 - DNA, 33 bp, homo sapien
gtgagatccacaagatrattctgtgagccgtca

SEQ ID NO: 5768 - DNA, 33 bp, homo sapien
ctacatctaacccttayttgaatctgttcccaa

SEQ ID NO: 5769 - DNA, 33 bp, homo sapien
ggatcactatttccacrtctcattggccttttg

SEQ ID NO: 5770 - DNA, 33 bp, homo sapien
cacagcaaataagcaayggaaccagaattcaaa

SEQ ID NO: 5771 - DNA, 33 bp, homo sapien
gtctggcaggtggaagrcattgagacgccttta

SEQ ID NO: 5772 - DNA, 33 bp, homo sapien
agccagccagacagagsctttggaagacagaaa

SEQ ID NO: 5773 - DNA, 33 bp, homo sapien
aacaggcttgaagtgaktttcagtgatatcttc

SEQ ID NO: 5774 - DNA, 33 bp, homo sapien
agttgctcagcttctaygtaccacgctcaaata

SEQ ID NO: 5775 - DNA, 33 bp, homo sapien
tgtgggaggtccatggwtgctatgtgtctggca

SEQ ID NO: 5776 - DNA, 33 bp, homo sapien
acccatgaggagatgcrctacattcaaaaagaa

SEQ ID NO: 5777 - DNA, 33 bp, homo sapien
agcacgcagggtttatygtatcgtgaacatcta

SEQ ID NO: 5778 - DNA, 33 bp, homo sapien
ttcatccgagtcttgarggaagagtgagaaaag

SEQ ID NO: 5779 - DNA, 33 bp, homo sapien
ttcacagcatagacacrattgcagtgttgggtg

SEQ ID NO: 5780 - DNA, 33 bp, homo sapien
aggacccagattatatrgggaaacagataagga

SEQ ID NO: 5781 - DNA, 33 bp, homo sapien
ttttttatttgtagaaytgaggtaataatatct

SEQ ID NO: 5782 - DNA, 33 bp, homo sapien
tccttcaaaaataaacrtatatgccatgagtgc

SEQ ID NO: 5783 - DNA, 33 bp, homo sapien
aatacgtataaggtccmaaatcacacttttgat

SEQ ID NO: 5784 - DNA, 33 bp, homo sapien
agctagtataactgcamgtattctgagtttgag

SEQ ID NO: 5785 - DNA, 33 bp, homo sapien
atcctagcagaattcaygccctgctaactgaag

SEQ ID NO: 5786 - DNA, 33 bp, homo sapien
cccaggaccacagagckagcaagcagcagatat

SEQ ID NO: 5787 - DNA, 33 bp, homo sapien
gtcctttccttttgaarttcctaggtaagcagc

SEQ ID NO: 5788 - DNA, 33 bp, homo sapien
tttctagttaactcgakgattttctattctctt

SEQ ID NO: 5789 - DNA, 33 bp, homo sapien
caggagctcctcacagygtagtggaagagaaag

SEQ ID NO: 5790 - DNA, 33 bp, homo sapien
cttcaccccatgaaaarttggcacctagttctt

SEQ ID NO: 5791 - DNA, 33 bp, homo sapien
tcttctacaatgaaatrtctatgcaaatcagcc

SEQ ID NO: 5792 - DNA, 33 bp, homo sapien
cagaaatacaaaaacawtgacccatggaacaga

SEQ ID NO: 5793 - DNA, 33 bp, homo sapien
ctggctacctctgggcygtcacccagcaagtgc

SEQ ID NO: 5794 - DNA, 33 bp, homo sapien
gcttctcatgtcagcastatggctcagaaggaa

SEQ ID NO: 5795 - DNA, 33 bp, homo sapien
tgaaagtttactctcamttttgtctcccgcagc

SEQ ID NO: 5796 - DNA, 33 bp, homo sapien
gccatatgagttcattmaaaaatatatacccct

SEQ ID NO: 5797 - DNA, 33 bp, homo sapien
tttatgccccagtgctygtctggtctaagctgg

SEQ ID NO: 5798 - DNA, 33 bp, homo sapien
gttttgctgtcacactwcaagctgcaaaagtta

SEQ ID NO: 5799 - DNA, 33 bp, homo sapien
gtatataactaatcccwttctagctacatataa

SEQ ID NO: 5800 - DNA, 33 bp, homo sapien
tgttttgtcagtcttaygatttctattttaatg

SEQ ID NO: 5801 - DNA, 33 bp, homo sapien
aacattggattacatayttcgaagtgacttaaa

SEQ ID NO: 5802 - DNA, 33 bp, homo sapien
caaaaggctacatatcrtctaattctgtttgtg

SEQ ID NO: 5803 - DNA, 33 bp, homo sapien
aactccaagcaaaatarcattgagtagacacat

SEQ ID NO: 5804 - DNA, 33 bp, homo sapien
aattactcggtgatttkttcaatatttcacatt

SEQ ID NO: 5805 - DNA, 33 bp, homo sapien
ctgaacctctggattcrgtaattggtagtactt

SEQ ID NO: 5806 - DNA, 33 bp, homo sapien
gcccagggtttagggaygctcagcaggccaggt

SEQ ID NO: 5807 - DNA, 33 bp, homo sapien
aggctgcctcagaatckcttggagagctccttg

SEQ ID NO: 5808 - DNA, 33 bp, homo sapien
gataagaggcttatttytaaactccttatctgc

SEQ ID NO: 5809 - DNA, 33 bp, homo sapien
cagcctagggaactatktaaattgattgtgaag

SEQ ID NO: 5810 - DNA, 33 bp, homo sapien
aaatttgttttgtctgygaaaatctataactct

SEQ ID NO: 5811 - DNA, 33 bp, homo sapien
gttcatgttctcagaaygttaccacactttata

SEQ ID NO: 5812 - DNA, 33 bp, homo sapien
ttggccttctccgagcygcaccttcctaagtag

SEQ ID NO: 5813 - DNA, 33 bp, homo sapien
ttatatacttagacatstttgaattttcaaaca

SEQ ID NO: 5814 - DNA, 33 bp, homo sapien
caaagctgtgcctttcwgattgcaaaacccgca

SEQ ID NO: 5815 - DNA, 33 bp, homo sapien
tggtatggtctcacttrcaatggaatatcatcc

SEQ ID NO: 5816 - DNA, 33 bp, homo sapien
ataaatttggccatcaytcgggaaaatccattt

SEQ ID NO: 5817 - DNA, 33 bp, homo sapien
tcttttcacctaataarcctgtcctactcaccc

SEQ ID NO: 5818 - DNA, 33 bp, homo sapien
gccattcccaacaagtytggctacgagtccccc

SEQ ID NO: 5819 - DNA, 33 bp, homo sapien
agcactaaatgcccacrgaagacagcaggagag

SEQ ID NO: 5820 - DNA, 33 bp, homo sapien
tacaataggtaggtgtrctggaatgctcccata

SEQ ID NO: 5821 - DNA, 33 bp, homo sapien
agctgattacattgtgyccacgcagattaaggg

SEQ ID NO: 5822 - DNA, 33 bp, homo sapien
tcagactggacatctaytgggaatccagaaggt

SEQ ID NO: 5823 - DNA, 33 bp, homo sapien
gctcctttggcatttgyttcaaacagcctgcat

SEQ ID NO: 5824 - DNA, 33 bp, homo sapien
aaatatataactacatmatttcagcagtatgcc

SEQ ID NO: 5825 - DNA, 33 bp, homo sapien
ctgactaattcaactartccctaacctttctat

SEQ ID NO: 5826 - DNA, 33 bp, homo sapien
cctgtatggtattgatrcttgcagatgtttgtc

SEQ ID NO: 5827 - DNA, 33 bp, homo sapien
agcagggaggcccctgktcctgaaagtgctgag

SEQ ID NO: 5828 - DNA, 33 bp, homo sapien
ttcacagaagaacaacyacagatgcaaggtaaa

SEQ ID NO: 5829 - DNA, 33 bp, homo sapien
tcttccttcttaacaakaaattggtgccagtca

SEQ ID NO: 5830 - DNA, 33 bp, homo sapien
tggcaactgcaacaatytgacttgacaacctag

SEQ ID NO: 5831 - DNA, 33 bp, homo sapien
agtttcccaaattattygtcattggcagagcgc

SEQ ID NO: 5832 - DNA, 33 bp, homo sapien
tagacaactctttttcrattaaaacctgaattg

SEQ ID NO: 5833 - DNA, 33 bp, homo sapien
acaatacagaagtttgwtttttaaaatgctgat

SEQ ID NO: 5834 - DNA, 33 bp, homo sapien
tagacctcagaaaaaawtgttccctctgagaga

SEQ ID NO: 5835 - DNA, 33 bp, homo sapien
agtaggaatgtaaacastatatgcctgtgtctc

SEQ ID NO: 5836 - DNA, 33 bp, homo sapien
ccctgttggccaagtcygagctgtgtcctggtg

SEQ ID NO: 5837 - DNA, 33 bp, homo sapien
ttctgtgaccaacgctrgacaaacatagctgag

SEQ ID NO: 5838 - DNA, 33 bp, homo sapien
tgtaggtgctttaggcmttccctggttgatgga

SEQ ID NO: 5839 - DNA, 33 bp, homo sapien
taaggaacatagtgggraaactagtcaggattt

SEQ ID NO: 5840 - DNA, 33 bp, homo sapien
gaactctttactggaayaaattagcacataaac

SEQ ID NO: 5841 - DNA, 33 bp, homo sapien
gcaatgcatatacatgygggagaaactcagaga

SEQ ID NO: 5842 - DNA, 33 bp, homo sapien
tagctgggcataagacmttgggagaaagatcca

SEQ ID NO: 5843 - DNA, 33 bp, homo sapien
ggagaggtctgatcccrctattgaaataaaaag

SEQ ID NO: 5844 - DNA, 33 bp, homo sapien
gaatgtttatagcagcrttttaaaaagtagcca

SEQ ID NO: 5845 - DNA, 33 bp, homo sapien
tcactggatttagtaaytgcaggtaagcaggac

SEQ ID NO: 5846 - DNA, 33 bp, homo sapien
atattgttgaaatgacraccaaggctttagaat

SEQ ID NO: 5847 - DNA, 33 bp, homo sapien
tcactcagtacagacaktcttcatgcaaagaaa

SEQ ID NO: 5848 - DNA, 33 bp, homo sapien
tattctctgaggttcartcatttgtcacttttg

SEQ ID NO: 5849 - DNA, 33 bp, homo sapien
gttatggcaggatttasaggtaaaggataaaga

SEQ ID NO: 5850 - DNA, 33 bp, homo sapien
cagatatttaaaaataygaccactttggtaggt

SEQ ID NO: 5851 - DNA, 33 bp, homo sapien
tatctttgctgcttcawcttgttctctgcaggt

SEQ ID NO: 5852 - DNA, 33 bp, homo sapien
tcacttccgctcatttycagtgatccactccca

SEQ ID NO: 5853 - DNA, 33 bp, homo sapien
gtgattatttaagcctyagttcctatatctaca

SEQ ID NO: 5854 - DNA, 33 bp, homo sapien
acaactttaaccttccrtttctatgataagtga

SEQ ID NO: 5855 - DNA, 33 bp, homo sapien
tgacacgtgggtattayggttcacaatgagatt

SEQ ID NO: 5856 - DNA, 33 bp, homo sapien
tttccatttgggatgaytaaaaagttttggaaa

SEQ ID NO: 5857 - DNA, 33 bp, homo sapien
ggaactggcaagactgraatttgaactcagggt

SEQ ID NO: 5858 - DNA, 33 bp, homo sapien
tcaaaatgctacaggcyggcgagctgggggatg

SEQ ID NO: 5859 - DNA, 33 bp, homo sapien
tctggtctgtgtgtatkctttgaactgcaattc

SEQ ID NO: 5860 - DNA, 33 bp, homo sapien
agatgtttaagggtcaytttgtaaattatcctt

SEQ ID NO: 5861 - DNA, 33 bp, homo sapien
aacagttctttgtagtytcataacaccctgaat

SEQ ID NO: 5862 - DNA, 33 bp, homo sapien
gaagactgaagcgcacrtttgatctaattgtgt

SEQ ID NO: 5863 - DNA, 33 bp, homo sapien
cttaggatgtcatgacmcttggtctgtaataga

SEQ ID NO: 5864 - DNA, 33 bp, homo sapien
ttaatgtgtcaatattwgttcaccaactgcaac

SEQ ID NO: 5865 - DNA, 33 bp, homo sapien
accctttctatggcaaycttgacagctcagtca

SEQ ID NO: 5866 - DNA, 33 bp, homo sapien
ctcgtataattctgatwtgacttagtgtatgct

SEQ ID NO: 5867 - DNA, 33 bp, homo sapien
tttgtaagggtttcagrttaaacattttgtttt

SEQ ID NO: 5868 - DNA, 33 bp, homo sapien
atgctttcttcaaaacytatttcaaaacctaca

SEQ ID NO: 5869 - DNA, 33 bp, homo sapien
aaattctcttttattaycagtgaatagtgtaag

SEQ ID NO: 5870 - DNA, 33 bp, homo sapien
ataccagcctttggcaygtgaagataattcttc

SEQ ID NO: 5871 - DNA, 33 bp, homo sapien
gttggagttctaacctstggtacctcagaatgt

SEQ ID NO: 5872 - DNA, 33 bp, homo sapien
tggaatgacaagatatwctcatttgcctagtac

SEQ ID NO: 5873 - DNA, 33 bp, homo sapien
tgtgacctactaactgygtagctttagacttgt

SEQ ID NO: 5874 - DNA, 33 bp, homo sapien
atatggtgaaatgactmtgggttctgtcatatt

SEQ ID NO: 5875 - DNA, 33 bp, homo sapien
tggtgccctctatacawgcaactatgcccagtg

SEQ ID NO: 5876 - DNA, 33 bp, homo sapien
gccttttattaactacrtgcgcttggacaattt

SEQ ID NO: 5877 - DNA, 33 bp, homo sapien
aaatgcaaaatacaccrgaaagtcccagcaata

SEQ ID NO: 5878 - DNA, 33 bp, homo sapien
gctacagtctcagttcrggtcttctagctttag

SEQ ID NO: 5879 - DNA, 33 bp, homo sapien
aaagtcttctctaatgytcatatagtgcggaca

SEQ ID NO: 5880 - DNA, 33 bp, homo sapien
ccaccacaaaatatgcwgcttgggcatgctgac

SEQ ID NO: 5881 - DNA, 33 bp, homo sapien
tatgcaatcaagaagaygctaaaaggatagtag

SEQ ID NO: 5882 - DNA, 33 bp, homo sapien
ccacaattattaatccrttcaactgttggtata

SEQ ID NO: 5883 - DNA, 33 bp, homo sapien
ttctctccagaaaatgyggttttgttttctata

SEQ ID NO: 5884 - DNA, 33 bp, homo sapien
atccgtgattattggtwgtaagccagacactga

SEQ ID NO: 5885 - DNA, 33 bp, homo sapien
catgggccaaggtctartttttcacacatacaa

SEQ ID NO: 5886 - DNA, 33 bp, homo sapien
agggtcaacatgaaagygttagtatgaaataac

SEQ ID NO: 5887 - DNA, 33 bp, homo sapien
aaaacaaaccgactcaraacattggattaaaat

SEQ ID NO: 5888 - DNA, 33 bp, homo sapien
tgcgtaaatcactcatyaattccacaactctct

SEQ ID NO: 5889 - DNA, 33 bp, homo sapien
tgttttgtaatgcatgwcccaaagtgtttttgt

SEQ ID NO: 5890 - DNA, 33 bp, homo sapien
cagtcatctgtcttatrtggcatgcttctgtga

SEQ ID NO: 5891 - DNA, 33 bp, homo sapien
gagatagttattgatasagggcaaagaatcggg

SEQ ID NO: 5892 - DNA, 33 bp, homo sapien
gtgaaaataacttaggrccaaagctggaacaat

SEQ ID NO: 5893 - DNA, 33 bp, homo sapien
tttaccctgcttgccakatagcatctagtcttc

SEQ ID NO: 5894 - DNA, 33 bp, homo sapien
ccattgtcaatagcaartgtttcaattgcctat

SEQ ID NO: 5895 - DNA, 33 bp, homo sapien
acaatccaagcaatggygtcagtcatttagtac

SEQ ID NO: 5896 - DNA, 33 bp, homo sapien
agttttttgctgtttgwtttatatgaaagtggt

SEQ ID NO: 5897 - DNA, 33 bp, homo sapien
tgtctaaccatggctgyttttaaggcattattt

SEQ ID NO: 5898 - DNA, 33 bp, homo sapien
gaaggaatgaggttccratgcatgctaccatgt

SEQ ID NO: 5899 - DNA, 33 bp, homo sapien
ctaatctaactggcttygtattgcacttttaag

SEQ ID NO: 5900 - DNA, 33 bp, homo sapien
ctctcacaatccaagcrtctgaaaattgtactt

SEQ ID NO: 5901 - DNA, 33 bp, homo sapien
atcaacaggtgaattcrtaaacaaactgtggta

SEQ ID NO: 5902 - DNA, 33 bp, homo sapien
tacaatgtaattcttcyggtgaatttaactgaa

SEQ ID NO: 5903 - DNA, 33 bp, homo sapien
gactgaagtcccatcamcacttcatgaaagacc

SEQ ID NO: 5904 - DNA, 33 bp, homo sapien
tccagaagatgaaagaygcttaataatggtctt

SEQ ID NO: 5905 - DNA, 33 bp, homo sapien
cttgctgataacttctrtatctaaaaatgctga

SEQ ID NO: 5906 - DNA, 33 bp, homo sapien
taatccatattcatacytatagcccactttact

SEQ ID NO: 5907 - DNA, 33 bp, homo sapien
attgaatttttgttttmgtaggcagctaatttg

SEQ ID NO: 5908 - DNA, 33 bp, homo sapien
aaaaccttggaagaaawtggacactctgatact

SEQ ID NO: 5909 - DNA, 33 bp, homo sapien
atctacttgcattacayctatgggtcttaaaat

SEQ ID NO: 5910 - DNA, 33 bp, homo sapien
taaggctagtgaaaatrataggtctaatatttc

SEQ ID NO: 5911 - DNA, 33 bp, homo sapien
acacttctgtattaaartcacaagaaaagcaaa

SEQ ID NO: 5912 - DNA, 33 bp, homo sapien
catgacatgtggtcacsagctgttggatgcatc

SEQ ID NO: 5913 - DNA, 33 bp, homo sapien
caggagagtggggcttytcacatgcagtccaga

SEQ ID NO: 5914 - DNA, 33 bp, homo sapien
aatggcgagctatcatrctgcattgttttaact

SEQ ID NO: 5915 - DNA, 33 bp, homo sapien
gacactacattagttakttaagcttacattctt

SEQ ID NO: 5916 - DNA, 33 bp, homo sapien
tgacttaaaaacctcayacatctcagtgccaga

SEQ ID NO: 5917 - DNA, 33 bp, homo sapien
tttattctatgattatkccaacattcacttact

SEQ ID NO: 5918 - DNA, 33 bp, homo sapien
ctgaaaactggcctggrttgacaagcgcaatgc

SEQ ID NO: 5919 - DNA, 33 bp, homo sapien
gctggtctttccttggytaacttcttcgagtgt

SEQ ID NO: 5920 - DNA, 33 bp, homo sapien
gtgcctgattcccagastacaatatggtatgtc

SEQ ID NO: 5921 - DNA, 33 bp, homo sapien
taaaagatcaatgaagraagtttccaaggtgtc

SEQ ID NO: 5922 - DNA, 33 bp, homo sapien
ccttcctcttgccttcmtctttcattgtaacat

SEQ ID NO: 5923 - DNA, 33 bp, homo sapien
tgagaaaaaaaaaagtyccaattcagatagagg

SEQ ID NO: 5924 - DNA, 33 bp, homo sapien
gtctggcttctttttcktagtataataatgttg

SEQ ID NO: 5925 - DNA, 33 bp, homo sapien
tggtgcctacatactckatatgttagatgatca

SEQ ID NO: 5926 - DNA, 33 bp, homo sapien
tgaccatggagtatacragagtcaaaagttggt

SEQ ID NO: 5927 - DNA, 33 bp, homo sapien
caacacagtcctagagrgaagaaagacacattc

SEQ ID NO: 5928 - DNA, 33 bp, homo sapien
taaaaggaaggtcctgygagctgcggctgtttg

SEQ ID NO: 5929 - DNA, 33 bp, homo sapien
cttggcaatactcatcrtatcagtgattggctt

SEQ ID NO: 5930 - DNA, 33 bp, homo sapien
cagataggtgaaaaaarcagcttataggctgtg

SEQ ID NO: 5931 - DNA, 33 bp, homo sapien
tcctgctctcctaatcrtctgcccaggaatctg

SEQ ID NO: 5932 - DNA, 33 bp, homo sapien
tgatagagtaagtctartaaagcgtggacatgt

SEQ ID NO: 5933 - DNA, 33 bp, homo sapien
catcttaataatcaatmctttggctgcttgctg

SEQ ID NO: 5934 - DNA, 33 bp, homo sapien
aagacaacacaataccratgaaggaaaaatata

SEQ ID NO: 5935 - DNA, 33 bp, homo sapien
tgggagagaaggacaasaagtagtgtgaaacaa

SEQ ID NO: 5936 - DNA, 33 bp, homo sapien
tagcactatgcctctcyactcgcaaagtcaaac

SEQ ID NO: 5937 - DNA, 33 bp, homo sapien
ttctttctcctgctacwtttcacttcttaattc

SEQ ID NO: 5938 - DNA, 33 bp, homo sapien
taagaacatggaagaartctattattaagtaca

SEQ ID NO: 5939 - DNA, 33 bp, homo sapien
tcagcctgcaggtaagscaagtgggcaagataa

SEQ ID NO: 5940 - DNA, 33 bp, homo sapien
gcattcttgctgtgttyttctcgagtagactga

SEQ ID NO: 5941 - DNA, 33 bp, homo sapien
atatctagcacagatgytatatctctagtttta

SEQ ID NO: 5942 - DNA, 33 bp, homo sapien
tctaccaaaaaaggccyttagagactcaatgcc

SEQ ID NO: 5943 - DNA, 33 bp, homo sapien
aagagcctgaaaggatytcccacaatcatctgg

SEQ ID NO: 5944 - DNA, 33 bp, homo sapien
tgttaaaacccatagamtatacaacatgatagt

SEQ ID NO: 5945 - DNA, 33 bp, homo sapien
atgtcagttaccagctyatcttcccaggcacag

SEQ ID NO: 5946 - DNA, 33 bp, homo sapien
ctcatcctacagtagayaaacatacccaatcaa

SEQ ID NO: 5947 - DNA, 33 bp, homo sapien
aattcagtttgcaaaascttcaatcatctaact

SEQ ID NO: 5948 - DNA, 33 bp, homo sapien
aggagttgtcagggctytgctgtaaatcctaaa

SEQ ID NO: 5949 - DNA, 33 bp, homo sapien
tggaggcactgcactakacatttttttctgatc

SEQ ID NO: 5950 - DNA, 33 bp, homo sapien
aggggattttgacctgytgttgctgactttgaa

SEQ ID NO: 5951 - DNA, 33 bp, homo sapien
tttctcatagtagcacrtgactttgaaaggaca

SEQ ID NO: 5952 - DNA, 33 bp, homo sapien
cacaaatttgtttccarttctccagcataatca

SEQ ID NO: 5953 - DNA, 33 bp, homo sapien
gcaaatactgcaagccratgaggtccacagcca

SEQ ID NO: 5954 - DNA, 33 bp, homo sapien
ctcagctagtaacaaaygcaagcttagaaccta

SEQ ID NO: 5955 - DNA, 33 bp, homo sapien
tgtcagaaaggttattrgagatagttgggtaga

SEQ ID NO: 5956 - DNA, 33 bp, homo sapien
ttctgctcttcatgccyataaggctgatccatg

SEQ ID NO: 5957 - DNA, 33 bp, homo sapien
tgtttttgcaattagcygaacacgtagcccagt

SEQ ID NO: 5958 - DNA, 33 bp, homo sapien
ctcctgcgttagaactrgagacaaacatacaac

SEQ ID NO: 5959 - DNA, 33 bp, homo sapien
cctgggccccggcaccraatgccaggaacaacc

SEQ ID NO: 5960 - DNA, 33 bp, homo sapien
gctatctccaccaatcrtgttatacctgggcat

SEQ ID NO: 5961 - DNA, 33 bp, homo sapien
ctaggaatgacagaatygggtatgtgagacttc

SEQ ID NO: 5962 - DNA, 33 bp, homo sapien
caaacaagatgtggcayaatgggaattaataca

SEQ ID NO: 5963 - DNA, 33 bp, homo sapien
gaaactcttccagagamtataagaaggatcacc

SEQ ID NO: 5964 - DNA, 33 bp, homo sapien
agcttttgaatagtatyagacacttttaaatag

SEQ ID NO: 5965 - DNA, 33 bp, homo sapien
tcctgcctgccacagascgaatcagtggaaggg

SEQ ID NO: 5966 - DNA, 33 bp, homo sapien
taactataatcatggcrgatgaaataaaaagag

SEQ ID NO: 5967 - DNA, 33 bp, homo sapien
gctttattcataaccayccaaacttggaagcaa

SEQ ID NO: 5968 - DNA, 33 bp, homo sapien
cctgtttttagcaacayggctagtaaatattga

SEQ ID NO: 5969 - DNA, 33 bp, homo sapien
tttacatacagcctacmttttaactaactcttg

SEQ ID NO: 5970 - DNA, 33 bp, homo sapien
tatttctggtccacgtrgatttctatgaatagc

SEQ ID NO: 5971 - DNA, 33 bp, homo sapien
ttttcacgtgatcaagyatcatagtcctcggta

SEQ ID NO: 5972 - DNA, 33 bp, homo sapien
cacctcggtggccgacstattcctggctactag

SEQ ID NO: 5973 - DNA, 33 bp, homo sapien
agcctgaggttctgcayctactgattcaaacaa

SEQ ID NO: 5974 - DNA, 33 bp, homo sapien
aaagacgattggataaktgaaaacaatgacttt

SEQ ID NO: 5975 - DNA, 33 bp, homo sapien
ggagtacttagtgagtyaaattcgaccatttaa

SEQ ID NO: 5976 - DNA, 33 bp, homo sapien
gggggcactctgaagaygtaattgtatcattgt

SEQ ID NO: 5977 - DNA, 33 bp, homo sapien
tcctaaggtggttgtcygagtgcccaaaggaca

SEQ ID NO: 5978 - DNA, 33 bp, homo sapien
ttcagcaaagcattccytgaccacacgccaggc

SEQ ID NO: 5979 - DNA, 33 bp, homo sapien
ggaattatgcaggtaawcgtgtgctagtcagtt

SEQ ID NO: 5980 - DNA, 33 bp, homo sapien
tccattatcgaggcccrggctcatatgtccttt

SEQ ID NO: 5981 - DNA, 33 bp, homo sapien
gatctcacgtcacatgyacatatggattttgct

SEQ ID NO: 5982 - DNA, 33 bp, homo sapien
atctgccaggtgcttcrccaagtgagtagatct

SEQ ID NO: 5983 - DNA, 33 bp, homo sapien
tttccaaccgattgaarttcaactctttttaca

SEQ ID NO: 5984 - DNA, 33 bp, homo sapien
tgtggtggccactctakgactgcaaggtacccc

SEQ ID NO: 5985 - DNA, 33 bp, homo sapien
acatgatgaaatctccraattttatctgtcctc

SEQ ID NO: 5986 - DNA, 33 bp, homo sapien
aacttctggaatacttrtgcaggacatgcaggt

SEQ ID NO: 5987 - DNA, 33 bp, homo sapien
cacccttgtataatctmtccataagtgtgtgtg

SEQ ID NO: 5988 - DNA, 33 bp, homo sapien
catttccatgttaaccytactaccacattcttc

SEQ ID NO: 5989 - DNA, 33 bp, homo sapien
gttgggagactaggtgytggatgtgctggagaa

SEQ ID NO: 5990 - DNA, 33 bp, homo sapien
gttaagcatggtctcaytaagaaccaggacagc

SEQ ID NO: 5991 - DNA, 33 bp, homo sapien
cttatccactctgttgytagatcacagaagcag

SEQ ID NO: 5992 - DNA, 33 bp, homo sapien
ttattcttgtacttttyttttggtggccacaag

SEQ ID NO: 5993 - DNA, 33 bp, homo sapien
catcagccgtagtttcktcatttcatattgaat

SEQ ID NO: 5994 - DNA, 33 bp, homo sapien
tcctgatggtcctcgcmacttctgagtcactcc

SEQ ID NO: 5995 - DNA, 33 bp, homo sapien
aaaaagaaaccactaarcgataaataattgagg

SEQ ID NO: 5996 - DNA, 33 bp, homo sapien
tcctgtgtgtcatccartcataacaggactttc

SEQ ID NO: 5997 - DNA, 33 bp, homo sapien
ttccctaactgactacmattaggggtttctaaa

SEQ ID NO: 5998 - DNA, 33 bp, homo sapien
tcttgacaaatctggtkagttctcaaggagtat

SEQ ID NO: 5999 - DNA, 33 bp, homo sapien
tcctcatccatgacatyaatagtttagcaattt

SEQ ID NO: 6000 - DNA, 33 bp, homo sapien
atgtactgaaggcttgmaacttccaggggaagg

SEQ ID NO: 6001 - DNA, 33 bp, homo sapien
tcagtagctgatgtgaygagtggctccctattg

SEQ ID NO: 6002 - DNA, 33 bp, homo sapien
aggactgcttaaggccrtaagtccgaaaccagc

SEQ ID NO: 6003 - DNA, 33 bp, homo sapien
aaggaagaaccatatcrtcaatgtcatgtgacc

SEQ ID NO: 6004 - DNA, 33 bp, homo sapien
tcatgagcttcatcagrgcagtcagtagaacat

SEQ ID NO: 6005 - DNA, 33 bp, homo sapien
ctttcttttgttcagayttgccttcccaggaaa

SEQ ID NO: 6006 - DNA, 33 bp, homo sapien
acaagaaaacctgaagwcttgaagattcactta

SEQ ID NO: 6007 - DNA, 33 bp, homo sapien
caccccacccaaccttygttctggtcacaccca

SEQ ID NO: 6008 - DNA, 33 bp, homo sapien
gagctgaagtaacgcckgagataaacttctttt

SEQ ID NO: 6009 - DNA, 33 bp, homo sapien
ccccagagccagacatwtattccgcaatggaaa

SEQ ID NO: 6010 - DNA, 33 bp, homo sapien
cacataggcaggctggraagtcagatgataaag

SEQ ID NO: 6011 - DNA, 33 bp, homo sapien
tcatcagatttcggaaygtgctgatctcagagg

SEQ ID NO: 6012 - DNA, 33 bp, homo sapien
ataagaaaattgagttycagggcagtaagttaa

SEQ ID NO: 6013 - DNA, 33 bp, homo sapien
acctgcttttatttttragaagatcaaagtagg

SEQ ID NO: 6014 - DNA, 33 bp, homo sapien
taacttttgaggatggstgttatccttctagat

SEQ ID NO: 6015 - DNA, 33 bp, homo sapien
gcacaaccccaaaagaktgatggcgtctccatc

SEQ ID NO: 6016 - DNA, 33 bp, homo sapien
cttagaattttgaagasacacaggcattcaaac

SEQ ID NO: 6017 - DNA, 33 bp, homo sapien
aataagcttttcatcartataatatacatgcag

SEQ ID NO: 6018 - DNA, 33 bp, homo sapien
gaaatggcattccaggytagctctgttacagca

SEQ ID NO: 6019 - DNA, 33 bp, homo sapien
ttttgactgcttgcttyaactattaatagtgaa

SEQ ID NO: 6020 - DNA, 33 bp, homo sapien
gccttttaacaagtcartttggtgattttgata

SEQ ID NO: 6021 - DNA, 33 bp, homo sapien
gattccttgcctgactwaaacgtgaaaaacact

SEQ ID NO: 6022 - DNA, 33 bp, homo sapien
gagactcttgcagaagrcaatggatatcggcag

SEQ ID NO: 6023 - DNA, 33 bp, homo sapien
agctattaaacaagtcrcacccttcttcctgca

SEQ ID NO: 6024 - DNA, 33 bp, homo sapien
tcaatatgaaatagctkctcctccagaaaccgt

SEQ ID NO: 6025 - DNA, 33 bp, homo sapien
cgtatatggcttttttwttcactgaatatggtt

SEQ ID NO: 6026 - DNA, 33 bp, homo sapien
aaatatggcaaaattayatatgagcttcccatt

SEQ ID NO: 6027 - DNA, 33 bp, homo sapien
gaaacatcggccttttycactggcaacttcaag

SEQ ID NO: 6028 - DNA, 33 bp, homo sapien
cttctctttggaccaamcttcctccttcacttc

SEQ ID NO: 6029 - DNA, 33 bp, homo sapien
ctgaccattcaatttcygtacttccaccagagc

SEQ ID NO: 6030 - DNA, 33 bp, homo sapien
aagagtgaattattacrggaaaaaaatagttaa

SEQ ID NO: 6031 - DNA, 33 bp, homo sapien
gggttaaggggaagaartagcattattggaacc

SEQ ID NO: 6032 - DNA, 33 bp, homo sapien
agaggacacttgaagcrtcacactaggaactct

SEQ ID NO: 6033 - DNA, 33 bp, homo sapien
agactaattgagaggcyctctgaatactctatg

SEQ ID NO: 6034 - DNA, 33 bp, homo sapien
cttatgggaggaaatgrcaggtgacctcattac

SEQ ID NO: 6035 - DNA, 33 bp, homo sapien
aggcacaggagtatgtrgaattgaattctgatg

SEQ ID NO: 6036 - DNA, 33 bp, homo sapien
ttatgataaagggttaragcagatagagattaa

SEQ ID NO: 6037 - DNA, 33 bp, homo sapien
aaggcaactcaatgaarccaaagtctttgacag

SEQ ID NO: 6038 - DNA, 33 bp, homo sapien
gtacttagcaaaatatkagataagtgtcagcaa

SEQ ID NO: 6039 - DNA, 33 bp, homo sapien
ctgaattataaggcacmtctatgtttaatcttt

SEQ ID NO: 6040 - DNA, 33 bp, homo sapien
gtgacctctgtaataasttgcctggtatggtac

SEQ ID NO: 6041 - DNA, 33 bp, homo sapien
aaggttggatttctttytccatggttaatgggt

SEQ ID NO: 6042 - DNA, 33 bp, homo sapien
aaggggcaaggaaagasaatcccaacatgtact

SEQ ID NO: 6043 - DNA, 33 bp, homo sapien
catgaatggtcagaatsaatatcatgtatatga

SEQ ID NO: 6044 - DNA, 33 bp, homo sapien
atgatgctacttttagygatggcaacttggatt

SEQ ID NO: 6045 - DNA, 33 bp, homo sapien
aacctggagaacataawcctaagtgaaaaagaa

SEQ ID NO: 6046 - DNA, 33 bp, homo sapien
ttttttagaagactgayattgcattaccacata

SEQ ID NO: 6047 - DNA, 33 bp, homo sapien
ttttgcctctgaggacmtatgccaatgaaggaa

SEQ ID NO: 6048 - DNA, 33 bp, homo sapien
tctggataaagctatgyactgtgtttgtcaggt

SEQ ID NO: 6049 - DNA, 33 bp, homo sapien
tgtggacacagagaggygtgaaagtagatatgt

SEQ ID NO: 6050 - DNA, 33 bp, homo sapien
actttcattttgtattyctgctctgtagtctct

SEQ ID NO: 6051 - DNA, 33 bp, homo sapien
tctcctaaagcagatamagattgaatcacaaca

SEQ ID NO: 6052 - DNA, 33 bp, homo sapien
gattcctggtggaacaygatccaactccaatga

SEQ ID NO: 6053 - DNA, 33 bp, homo sapien
atcttggaagcgacttygaaattattatatacg

SEQ ID NO: 6054 - DNA, 33 bp, homo sapien
atttaactgaagttcakttgctttgcagataaa

SEQ ID NO: 6055 - DNA, 33 bp, homo sapien
gcttggtggtggaaccygttctcactccagtct

SEQ ID NO: 6056 - DNA, 33 bp, homo sapien
aacatgtataattaacyagaagtccagtagagt

SEQ ID NO: 6057 - DNA, 33 bp, homo sapien
cagcaagagagaccaamactcactgaacactta

SEQ ID NO: 6058 - DNA, 33 bp, homo sapien
ttggaaagaatggtagrtgggaacatccaatga

SEQ ID NO: 6059 - DNA, 33 bp, homo sapien
cataaattctgacaggycttgtgttgtgttggg

SEQ ID NO: 6060 - DNA, 33 bp, homo sapien
agagaatgctgtggtamgagaggaagagaaagg

SEQ ID NO: 6061 - DNA, 33 bp, homo sapien
tgtattgctcatagtastggaggcaagaaatct

SEQ ID NO: 6062 - DNA, 33 bp, homo sapien
ctgagtcctgttgagcrtagcagagatgaagcc

SEQ ID NO: 6063 - DNA, 33 bp, homo sapien
cttagaagccatattcmaattcagccatttata

SEQ ID NO: 6064 - DNA, 33 bp, homo sapien
tgttcctctcatacgcraaatatattcactcta

SEQ ID NO: 6065 - DNA, 33 bp, homo sapien
atgactgcacaaagatrctaataacaaacagag

SEQ ID NO: 6066 - DNA, 33 bp, homo sapien
actgtcctcagatatcygtcctctttaggattt

SEQ ID NO: 6067 - DNA, 33 bp, homo sapien
tagctggctctccgtarttatctcttcaattaa

SEQ ID NO: 6068 - DNA, 33 bp, homo sapien
gcatctttacaaaaagraaaaattagtatggca

SEQ ID NO: 6069 - DNA, 33 bp, homo sapien
tgtttgctaatagtagyggcctacaaatctgtg

SEQ ID NO: 6070 - DNA, 33 bp, homo sapien
cctacagctcatggtcytgtgcaaattaataac

SEQ ID NO: 6071 - DNA, 33 bp, homo sapien
aaggtacctaattatcwcataaatcttttggta

SEQ ID NO: 6072 - DNA, 33 bp, homo sapien
aatggtttcatagatayatgtcaaaacttacca

SEQ ID NO: 6073 - DNA, 33 bp, homo sapien
gacaagatggttatatwgcagggctcacttgca

SEQ ID NO: 6074 - DNA, 33 bp, homo sapien
aaatgagagttattacrgagctgtgaacttctt

SEQ ID NO: 6075 - DNA, 33 bp, homo sapien
attccactcccagataygtacccaagagaaatg

SEQ ID NO: 6076 - DNA, 33 bp, homo sapien
gaacaaggtacggatgwgtaaagcacatggaca

SEQ ID NO: 6077 - DNA, 33 bp, homo sapien
cagcagtggaggtttgycactaggatttcccct

SEQ ID NO: 6078 - DNA, 33 bp, homo sapien
gtgatctaacatttgawagtgatttgaaaaatt

SEQ ID NO: 6079 - DNA, 33 bp, homo sapien
ccatgaataaatctaaycagtgagagtcagcat

SEQ ID NO: 6080 - DNA, 33 bp, homo sapien
aacttgctcctcaagtyggcattccttcttgta

SEQ ID NO: 6081 - DNA, 33 bp, homo sapien
ctatttggagatagagsctttcaagaaatgact

SEQ ID NO: 6082 - DNA, 33 bp, homo sapien
taccaagattgaaataygaagacatggaaaacc

SEQ ID NO: 6083 - DNA, 33 bp, homo sapien
agtacatactaatgctrtgcttctattttggtc

SEQ ID NO: 6084 - DNA, 33 bp, homo sapien
tcaaatgttctgctttyctcttgacctgcataa

SEQ ID NO: 6085 - DNA, 33 bp, homo sapien
ggacctggactatgatrgccacagcagctaaag

SEQ ID NO: 6086 - DNA, 33 bp, homo sapien
attatgctgtgtttttrgttagctctccataga

SEQ ID NO: 6087 - DNA, 33 bp, homo sapien
ttccaagccatttaacsatgtcccagaacaaaa

SEQ ID NO: 6088 - DNA, 33 bp, homo sapien
cttctgtgtactcatasacttgacaacatgtgg

SEQ ID NO: 6089 - DNA, 33 bp, homo sapien
aaaacctcgaacattgytatggtctcttccagc

SEQ ID NO: 6090 - DNA, 33 bp, homo sapien
actttggagaaattacytaatcagcctgcacat

SEQ ID NO: 6091 - DNA, 33 bp, homo sapien
gtctaaggcttgtagayaggataactcatttaa

SEQ ID NO: 6092 - DNA, 33 bp, homo sapien
tcgcctctctgttgatktatacactgaaaacaa

SEQ ID NO: 6093 - DNA, 33 bp, homo sapien
cgggccacatatcgtcrtggcagaacatagatt

SEQ ID NO: 6094 - DNA, 33 bp, homo sapien
agtcttctgggaagctygtcccattttagttga

SEQ ID NO: 6095 - DNA, 33 bp, homo sapien
agtaggcagttgatttwaaaaaaaacttgatga

SEQ ID NO: 6096 - DNA, 33 bp, homo sapien
gcttcatcctgacaacrtgttcaacaaagttct

SEQ ID NO: 6097 - DNA, 33 bp, homo sapien
ttggtgagggatcgtayggtatgaaaccccctt

SEQ ID NO: 6098 - DNA, 33 bp, homo sapien
aggtgatgctcaacaakccacttatcttatgag

SEQ ID NO: 6099 - DNA, 33 bp, homo sapien
tgtcactgcagcaatarggaagtaatacagtgc

SEQ ID NO: 6100 - DNA, 33 bp, homo sapien
agtttgtttggtgcacycatatttgttcttgga

SEQ ID NO: 6101 - DNA, 33 bp, homo sapien
gattttcctaatttatrttgcacttacaacacc

SEQ ID NO: 6102 - DNA, 33 bp, homo sapien
ccaatccctattttgcyaagcttagattcacca

SEQ ID NO: 6103 - DNA, 33 bp, homo sapien
agggaacagtaaatacmaataccctaagccaac

SEQ ID NO: 6104 - DNA, 33 bp, homo sapien
ttatctttcaaaaaagraaaactggcaaaacat

SEQ ID NO: 6105 - DNA, 33 bp, homo sapien
gcctacttctctattcrgtttatgattctataa

SEQ ID NO: 6106 - DNA, 33 bp, homo sapien
tgtatttgcattaagcrttttataaagtaatga

SEQ ID NO: 6107 - DNA, 33 bp, homo sapien
aactccgtgcagcaggrtggtatacagaatata

SEQ ID NO: 6108 - DNA, 33 bp, homo sapien
catctcagtctcacacrgaaatattaactttct

SEQ ID NO: 6109 - DNA, 33 bp, homo sapien
ctcataactggtcaacrtatccatcactccatt

SEQ ID NO: 6110 - DNA, 33 bp, homo sapien
tttagcatagtgtagcwttttaagagtatgagt

SEQ ID NO: 6111 - DNA, 33 bp, homo sapien
actgactcaaatgtcartttcctctggcaacac

SEQ ID NO: 6112 - DNA, 33 bp, homo sapien
ccttgtaagaatgtackggcattgaagcactga

SEQ ID NO: 6113 - DNA, 33 bp, homo sapien
tcaaactttctccatawcaataggctgttttat

SEQ ID NO: 6114 - DNA, 33 bp, homo sapien
tgcatgaagaggtgccrtaattattaaacatga

SEQ ID NO: 6115 - DNA, 33 bp, homo sapien
gtaaagttggcttcacstttgggctggctttcc

SEQ ID NO: 6116 - DNA, 33 bp, homo sapien
gcctgaccccaaaactstctgattcagtaggct

SEQ ID NO: 6117 - DNA, 33 bp, homo sapien
acagcacttgagtagtsactggtaaagaggact

SEQ ID NO: 6118 - DNA, 33 bp, homo sapien
tcagggctgaagcagtscgcaaggttaactcca

SEQ ID NO: 6119 - DNA, 33 bp, homo sapien
agtatccagcacagtgmattaacgtaaacctaa

SEQ ID NO: 6120 - DNA, 33 bp, homo sapien
cacacaacttgatcaaygaaatattaaacatcc

SEQ ID NO: 6121 - DNA, 33 bp, homo sapien
agagtaagtattgaggyttctcaggcaatgggc

SEQ ID NO: 6122 - DNA, 33 bp, homo sapien
catttaggctatttacrtaaaactttagtagtg

SEQ ID NO: 6123 - DNA, 33 bp, homo sapien
tgaaatacatgtgatcrtaagaagcaacaatag

SEQ ID NO: 6124 - DNA, 33 bp, homo sapien
tttttacaatatcagcycattaagcatcatttc

SEQ ID NO: 6125 - DNA, 33 bp, homo sapien
taaataccaaggagcayaactgttgaatcacat

SEQ ID NO: 6126 - DNA, 33 bp, homo sapien
atcagaaatgaagaagytgcataatgatgaagc

SEQ ID NO: 6127 - DNA, 33 bp, homo sapien
attcttaaaaaatttcytcattgggtgttctag

SEQ ID NO: 6128 - DNA, 33 bp, homo sapien
agttatctatatgtacmtacacatgcggatgtt

SEQ ID NO: 6129 - DNA, 33 bp, homo sapien
acttgaaggtgaacttkgcatcagaaacaagat

SEQ ID NO: 6130 - DNA, 33 bp, homo sapien
tgtggtgccttggtatsctcatctgtaatgtgg

SEQ ID NO: 6131 - DNA, 33 bp, homo sapien
aaacaaagaattgcctratatcataaaaacagt

SEQ ID NO: 6132 - DNA, 33 bp, homo sapien
ttatgttaagctgatgrtaaaagaagtttcatt

SEQ ID NO: 6133 - DNA, 33 bp, homo sapien
aaatgctctggttatcrggacagagaaatatct

SEQ ID NO: 6134 - DNA, 33 bp, homo sapien
ttattttgactttcccrttgcagtggctaagac

SEQ ID NO: 6135 - DNA, 33 bp, homo sapien
ctgaaagtcaccagttrccagagctgcaaattt

SEQ ID NO: 6136 - DNA, 33 bp, homo sapien
aaaagtttattcttctytggttgatgagattcc

SEQ ID NO: 6137 - DNA, 33 bp, homo sapien
cctgactggcccagtayagccgatggaagtcag

SEQ ID NO: 6138 - DNA, 33 bp, homo sapien
ttgaagagtaactgtgrtaggttccgaagttgg

SEQ ID NO: 6139 - DNA, 33 bp, homo sapien
agtgaactactggaatraggacacagggaataa

SEQ ID NO: 6140 - DNA, 33 bp, homo sapien
aaattaaccctggagtygagtttcacaaagata

SEQ ID NO: 6141 - DNA, 33 bp, homo sapien
atggagactggctcccrctatgtaaaggctgat

SEQ ID NO: 6142 - DNA, 33 bp, homo sapien
ggaatctatcttgagartggaatttgccactta

SEQ ID NO: 6143 - DNA, 33 bp, homo sapien
tttattgctagactcgytttgctaacattttgt

SEQ ID NO: 6144 - DNA, 33 bp, homo sapien
cttgtgagtagaacgtyacttgatccttggatc

SEQ ID NO: 6145 - DNA, 33 bp, homo sapien
catgtggtttgtttagraagcagtgggttctat

SEQ ID NO: 6146 - DNA, 33 bp, homo sapien
acacagctgtgaacagrtggataaggtctctgt

SEQ ID NO: 6147 - DNA, 33 bp, homo sapien
tggtgggaaaaataacrgaaccaataactgtta

SEQ ID NO: 6148 - DNA, 33 bp, homo sapien
tttcaaggatgatcaakttccaccaagtattct

SEQ ID NO: 6149 - DNA, 33 bp, homo sapien
ttctataattcctctcrtgccctgcctaggact

SEQ ID NO: 6150 - DNA, 33 bp, homo sapien
caaaggtaagtcatttyaaattttcactatcaa

SEQ ID NO: 6151 - DNA, 33 bp, homo sapien
atgtcaatggtaagatkttggactaagtttatg

SEQ ID NO: 6152 - DNA, 33 bp, homo sapien
cactggtcaaatccaaytggaacccaggtggca

SEQ ID NO: 6153 - DNA, 33 bp, homo sapien
tctgatgcattgtttcrtatgccaattgtattt

SEQ ID NO: 6154 - DNA, 33 bp, homo sapien
tttcttaatggttcatwgttttggtattgtatc

SEQ ID NO: 6155 - DNA, 33 bp, homo sapien
accaaatatctaggtayggagacagccttgaag

SEQ ID NO: 6156 - DNA, 33 bp, homo sapien
cctaagagaacgctaarcatgggatcaaaagag

SEQ ID NO: 6157 - DNA, 33 bp, homo sapien
tgctgtaaggagtagarttaacagaagacagag

SEQ ID NO: 6158 - DNA, 33 bp, homo sapien
ttataaacccagatgayatcttagctgggaatg

SEQ ID NO: 6159 - DNA, 33 bp, homo sapien
tttctggttttgcattktaaattaaagtctatg

SEQ ID NO: 6160 - DNA, 33 bp, homo sapien
ttctgctatttggagtyagtttctcccaccaca

SEQ ID NO: 6161 - DNA, 33 bp, homo sapien
ttgagagaagggaaccrtcctgaattacctagg

SEQ ID NO: 6162 - DNA, 33 bp, homo sapien
atatttctccttaagtwcaattggattttccag

SEQ ID NO: 6163 - DNA, 33 bp, homo sapien
aaaaacattatgccaartgaaacaaatcaagat

SEQ ID NO: 6164 - DNA, 33 bp, homo sapien
caacccagaagaataaratcagaggactgacgt

SEQ ID NO: 6165 - DNA, 33 bp, homo sapien
ccacttttgctgaaaaygtgaacttgttaagaa

SEQ ID NO: 6166 - DNA, 33 bp, homo sapien
gagccaggaggtggacrtaatttaccctcagcc

SEQ ID NO: 6167 - DNA, 33 bp, homo sapien
actcttctcgtggaaayaagaaattcaactaaa

SEQ ID NO: 6168 - DNA, 33 bp, homo sapien
gtaggaataattagcasaataggcagcaaatct

SEQ ID NO: 6169 - DNA, 33 bp, homo sapien
gaggatggtgtaccacrgggagcctggacatac

SEQ ID NO: 6170 - DNA, 33 bp, homo sapien
ccttaaggacaatattrgacatctgctttcatc

SEQ ID NO: 6171 - DNA, 33 bp, homo sapien
agacaggttcacattgytttccactcatcaaac

SEQ ID NO: 6172 - DNA, 33 bp, homo sapien
gcctccatcttttaagratgcttgtaattatgt

SEQ ID NO: 6173 - DNA, 33 bp, homo sapien
tgacaatttggctgaayacaaaacactggatac

SEQ ID NO: 6174 - DNA, 33 bp, homo sapien
accattcctttcattcrccagttttgaaactct

SEQ ID NO: 6175 - DNA, 33 bp, homo sapien
ctctgagtctgcaagakccaagcattactgggc

SEQ ID NO: 6176 - DNA, 33 bp, homo sapien
ataaatcaaatccattkaaggccaataataaat

SEQ ID NO: 6177 - DNA, 33 bp, homo sapien
tggcttcactgataaayagactcacctgtccat

SEQ ID NO: 6178 - DNA, 33 bp, homo sapien
ccatgagtgatggagtyggctctttcctggtga

SEQ ID NO: 6179 - DNA, 33 bp, homo sapien
gagcagcagcagagccmgtagaaaagaacacaa

SEQ ID NO: 6180 - DNA, 33 bp, homo sapien
ttctattgttcttggasgcataaacaaaaaata

SEQ ID NO: 6181 - DNA, 33 bp, homo sapien
atctttgtttggagaawtttacttgccttaaat

SEQ ID NO: 6182 - DNA, 33 bp, homo sapien
tgtcagacacagtcagrtccgttagcaaacaca

SEQ ID NO: 6183 - DNA, 33 bp, homo sapien
gtcctttctattgatawctatcctcaccctcaa

SEQ ID NO: 6184 - DNA, 33 bp, homo sapien
aaagagaataagacccrggaaaaatcgatgttg

SEQ ID NO: 6185 - DNA, 33 bp, homo sapien
gttatacttcacaactrctagggtggctgtaat

SEQ ID NO: 6186 - DNA, 33 bp, homo sapien
aatgtgtctgtccaacrcgctatgaaggaccaa

SEQ ID NO: 6187 - DNA, 33 bp, homo sapien
tgcttcatgtggcactkttatgctatgcagaca

SEQ ID NO: 6188 - DNA, 33 bp, homo sapien
attcaaactttccttcygataggtttttccaag

SEQ ID NO: 6189 - DNA, 33 bp, homo sapien
gtcaacctgggatactygagtttggtggggggt

SEQ ID NO: 6190 - DNA, 33 bp, homo sapien
ataaatcataccctatrgttaaaaaatgtacaa

SEQ ID NO: 6191 - DNA, 33 bp, homo sapien
tgtttgcctttctgtakccagtcatcccaaggc

SEQ ID NO: 6192 - DNA, 33 bp, homo sapien
atgtctcctggctctcrgttcagagattcagct

SEQ ID NO: 6193 - DNA, 33 bp, homo sapien
atctgagttacaggtaraaactgaaatggaaga

SEQ ID NO: 6194 - DNA, 33 bp, homo sapien
gagtgacagaaaccatraataggaaaagcaaaa

SEQ ID NO: 6195 - DNA, 33 bp, homo sapien
tcacatagactttcatktaacggaaatggcttc

SEQ ID NO: 6196 - DNA, 33 bp, homo sapien
aatatttaagagaagtwtgcaagaattcagaac

SEQ ID NO: 6197 - DNA, 33 bp, homo sapien
aattctatcactgcttytggttgaatcatgaca

SEQ ID NO: 6198 - DNA, 33 bp, homo sapien
aatgattgaaggattcyatgagaaaaaatatca

SEQ ID NO: 6199 - DNA, 33 bp, homo sapien
actaaatccaattatartccatttctcataccc

SEQ ID NO: 6200 - DNA, 33 bp, homo sapien
ctagtgtacgacaaagrctactccaataagtgg

SEQ ID NO: 6201 - DNA, 33 bp, homo sapien
aaagaatctatggttcygtgatgctgactgatc

SEQ ID NO: 6202 - DNA, 33 bp, homo sapien
acttttagaacttttgyataaattcactgctaa

SEQ ID NO: 6203 - DNA, 33 bp, homo sapien
gggcttcagaaagcttstttcagtttggctgaa

SEQ ID NO: 6204 - DNA, 33 bp, homo sapien
ggaacgtgcactttgcygaacatggatcacagt

SEQ ID NO: 6205 - DNA, 33 bp, homo sapien
tacctaccctctgtcartaacttactaattaga

SEQ ID NO: 6206 - DNA, 33 bp, homo sapien
ggaagcctctctgttcmaccagaacagccatga

SEQ ID NO: 6207 - DNA, 33 bp, homo sapien
atcacttaaacacaccyagtgctcaaatcatac

SEQ ID NO: 6208 - DNA, 33 bp, homo sapien
tcagaccatcagagaaytcagccagcctagctg

SEQ ID NO: 6209 - DNA, 33 bp, homo sapien
atcatcaagtcctattmttgaattatcccccaa

SEQ ID NO: 6210 - DNA, 33 bp, homo sapien
catctgagtacatttcygggtcggctaatttca

SEQ ID NO: 6211 - DNA, 33 bp, homo sapien
agttcttgtctgcattygttaaaggaaaactat

SEQ ID NO: 6212 - DNA, 33 bp, homo sapien
tggaatcaaatcctgtygttgtaggtaaaattt

SEQ ID NO: 6213 - DNA, 33 bp, homo sapien
ttatgtactgtgttcartctttggttactctgt

SEQ ID NO: 6214 - DNA, 33 bp, homo sapien
ccagtttgttcacactycactgtatccctgccc

SEQ ID NO: 6215 - DNA, 33 bp, homo sapien
ggattttggtcttaggkaaataaatcattgaag

SEQ ID NO: 6216 - DNA, 33 bp, homo sapien
tatgcttctgcttgacmaacatgcttttataat

SEQ ID NO: 6217 - DNA, 33 bp, homo sapien
ggaggaattggaacacratctaactgttgctta

SEQ ID NO: 6218 - DNA, 33 bp, homo sapien
ttgttgaatctcttcaktagctcatttacatta

SEQ ID NO: 6219 - DNA, 33 bp, homo sapien
cacagattgagttaatyttttgagctatggtct

SEQ ID NO: 6220 - DNA, 33 bp, homo sapien
ataatcataagggtctrtaaaagtagaaaagag

SEQ ID NO: 6221 - DNA, 33 bp, homo sapien
gtatagggtaccagtcmgagtcatgaggccccc

SEQ ID NO: 6222 - DNA, 33 bp, homo sapien
tggggcagatgatttayggccagcttttgtaca

SEQ ID NO: 6223 - DNA, 33 bp, homo sapien
tttttcctggtctttcraagccatctctgaatg

SEQ ID NO: 6224 - DNA, 33 bp, homo sapien
acactatattatctttrtgcagtatcccttcag

SEQ ID NO: 6225 - DNA, 33 bp, homo sapien
taaccaatgtatttccrgtgcagtgttctatct

SEQ ID NO: 6226 - DNA, 33 bp, homo sapien
cagaccctctcagccaygaattaacttgctctt

SEQ ID NO: 6227 - DNA, 33 bp, homo sapien
tgtttttatgcttttgrtccttcccatataaaa

SEQ ID NO: 6228 - DNA, 33 bp, homo sapien
ggctctcccaggtgttkaccctctaccattctg

SEQ ID NO: 6229 - DNA, 33 bp, homo sapien
gggggaggagttgggaygaaggtatcaataaag

SEQ ID NO: 6230 - DNA, 33 bp, homo sapien
ttaaatgttcataccamaaaaataaaaaggaaa

SEQ ID NO: 6231 - DNA, 33 bp, homo sapien
aataagagaattttctygggtgatagaaatgtt

SEQ ID NO: 6232 - DNA, 33 bp, homo sapien
ggattctatgttgtctragctaatcataaaaat

SEQ ID NO: 6233 - DNA, 33 bp, homo sapien
gctaatcaactggattrattggatgctttacaa

SEQ ID NO: 6234 - DNA, 33 bp, homo sapien
ttcataataaataaaaygactgttgaaagaagg

SEQ ID NO: 6235 - DNA, 33 bp, homo sapien
ttccaagagtgttctcwacatatttaaaaaact

SEQ ID NO: 6236 - DNA, 33 bp, homo sapien
tgttaaagggacatcgraatctcgacatcccga

SEQ ID NO: 6237 - DNA, 33 bp, homo sapien
ccagaattcagacccaraatttttgctctaaac

SEQ ID NO: 6238 - DNA, 33 bp, homo sapien
atcttgcttcaccttcygagaaatgctcgccct

SEQ ID NO: 6239 - DNA, 33 bp, homo sapien
agtttgtatgaaatagmactccaaggcatcttg

SEQ ID NO: 6240 - DNA, 33 bp, homo sapien
tgcaaggtgctcgtgargattaaatgcattaat

SEQ ID NO: 6241 - DNA, 33 bp, homo sapien
ctctgcagaaacggacycagcagagcaggacca

SEQ ID NO: 6242 - DNA, 33 bp, homo sapien
ttttaaaatgtgcctaygtccttccaactgtat

SEQ ID NO: 6243 - DNA, 33 bp, homo sapien
aaaaaagccattcgtcrgacagtgtcaataggc

SEQ ID NO: 6244 - DNA, 33 bp, homo sapien
gacctccatttgtattmttgtctcagacctcaa

SEQ ID NO: 6245 - DNA, 33 bp, homo sapien
tcaggtgcattccattwaattcctcagagggtc

SEQ ID NO: 6246 - DNA, 33 bp, homo sapien
ctttggcccaacaaagkttcagaaatgtcatcc

SEQ ID NO: 6247 - DNA, 33 bp, homo sapien
aaagaaataaaagtggytgctgattggagtgag

SEQ ID NO: 6248 - DNA, 33 bp, homo sapien
tcaacttctaacaaaasaaacatatcttctacc

SEQ ID NO: 6249 - DNA, 33 bp, homo sapien
tctaactgttcacacayttgagaccaaccctta

SEQ ID NO: 6250 - DNA, 33 bp, homo sapien
aatgtgatagatatcasaatactcacaatctct

SEQ ID NO: 6251 - DNA, 33 bp, homo sapien
ataaatggaaagatatrtatgcatctttgtggt

SEQ ID NO: 6252 - DNA, 33 bp, homo sapien
actatactatgtttggyaagcatgtgggaaaac

SEQ ID NO: 6253 - DNA, 33 bp, homo sapien
ccttgtagattgtgagrcaggttcaggaacaag

SEQ ID NO: 6254 - DNA, 33 bp, homo sapien
ttttgcctctaaggacrccaggctctgttatcc

SEQ ID NO: 6255 - DNA, 33 bp, homo sapien
tcaagatagagttgtcrtttttagggagaagtc

SEQ ID NO: 6256 - DNA, 33 bp, homo sapien
gcaaactatggtctctkagtgatagtgatgtgt

SEQ ID NO: 6257 - DNA, 33 bp, homo sapien
gactgtcaaaggaaagrgtgcaatcagaggata

SEQ ID NO: 6258 - DNA, 33 bp, homo sapien
atttgctcatggttgtwctggagagcaatttgt

SEQ ID NO: 6259 - DNA, 33 bp, homo sapien
gttaaatagcagataakacacaattaaagagaa

SEQ ID NO: 6260 - DNA, 33 bp, homo sapien
cacacatatttcaggtkgagcaaatgcttattt

SEQ ID NO: 6261 - DNA, 33 bp, homo sapien
aacttttattaccattytgtagcagaacctata

SEQ ID NO: 6262 - DNA, 33 bp, homo sapien
ttgcaacagggaccacygggaagctcactgtgg

SEQ ID NO: 6263 - DNA, 33 bp, homo sapien
ttggtaaaaataataargttcaaaagccagtaa

SEQ ID NO: 6264 - DNA, 33 bp, homo sapien
accatatggcacacaastctaaaattttactat

SEQ ID NO: 6265 - DNA, 33 bp, homo sapien
ctggcaccacagattcytataaacaccaaagga

SEQ ID NO: 6266 - DNA, 33 bp, homo sapien
caacgttattgggatgmccccttgaataagtct

SEQ ID NO: 6267 - DNA, 33 bp, homo sapien
cagggatgcttccaagrcaattggctcgggcac

SEQ ID NO: 6268 - DNA, 33 bp, homo sapien
aaataatttacaagcaygtttcaaaaaccacca

SEQ ID NO: 6269 - DNA, 33 bp, homo sapien
cacaaatacaataatgygctcaggagtgcagtc

SEQ ID NO: 6270 - DNA, 33 bp, homo sapien
ccttgcaaacagagtaygactcccttattcatc

SEQ ID NO: 6271 - DNA, 33 bp, homo sapien
atgtcctatggttacaygtccttccctggatac

SEQ ID NO: 6272 - DNA, 33 bp, homo sapien
aaagaaaagtaagaggrtgccaaaaatgactcc

SEQ ID NO: 6273 - DNA, 33 bp, homo sapien
cagaggtctgaatttgrtgacagacttaatatg

SEQ ID NO: 6274 - DNA, 33 bp, homo sapien
gaattcagaattaagcrtagtagatatgtaaac

SEQ ID NO: 6275 - DNA, 33 bp, homo sapien
tgtgaatctgactactratgcagctaaatgttt

SEQ ID NO: 6276 - DNA, 33 bp, homo sapien
agtgagtggcaagctcwaatttaaactctagca

SEQ ID NO: 6277 - DNA, 33 bp, homo sapien
tcagaaaggaaggtcasagtgattgtcacatga

SEQ ID NO: 6278 - DNA, 33 bp, homo sapien
ccagtcacccaagggasataaactgaggaccag

SEQ ID NO: 6279 - DNA, 33 bp, homo sapien
ctccaataggatttacrtctacatatgcagaag

SEQ ID NO: 6280 - DNA, 33 bp, homo sapien
tgagctataatgtggtmaagattagtattgtta

SEQ ID NO: 6281 - DNA, 33 bp, homo sapien
cccatgtacggttgcaytgctgactaagtatat

SEQ ID NO: 6282 - DNA, 33 bp, homo sapien
gagattatcctatgtcrtatggcccaacgttac

SEQ ID NO: 6283 - DNA, 33 bp, homo sapien
ctgagaatgattgaatyggctaaatatctctcc

SEQ ID NO: 6284 - DNA, 33 bp, homo sapien
gcatgagtggagaagtmgttaccttttaccttg

SEQ ID NO: 6285 - DNA, 33 bp, homo sapien
caccggcatgagtccarctgaaaaaattgacag

SEQ ID NO: 6286 - DNA, 33 bp, homo sapien
caatccctgaggccacrtaaagttagatcttct

SEQ ID NO: 6287 - DNA, 33 bp, homo sapien
ctttcctccaaaatacygagtgaggtctctctc

SEQ ID NO: 6288 - DNA, 33 bp, homo sapien
ttaaaaactgaacaaakgattgtttctccaaat

SEQ ID NO: 6289 - DNA, 33 bp, homo sapien
acgagctgctgagctarccaacggtggaaattc

SEQ ID NO: 6290 - DNA, 33 bp, homo sapien
tgggggatttcatgctrgattccaacttgttcg

SEQ ID NO: 6291 - DNA, 33 bp, homo sapien
gttatttacattacacrttgcggtgccataggg

SEQ ID NO: 6292 - DNA, 33 bp, homo sapien
actccacatgacacttytgacaccagctgtgta

SEQ ID NO: 6293 - DNA, 33 bp, homo sapien
cttccatagacactgaygttcagttttgcttgt

SEQ ID NO: 6294 - DNA, 33 bp, homo sapien
tggtacagatgataagraacatttgagatctct

SEQ ID NO: 6295 - DNA, 33 bp, homo sapien
ttgaagatcttaaccayattgccaactggagca

SEQ ID NO: 6296 - DNA, 33 bp, homo sapien
tggacggactcttaagmtgcagtggcgaaagca

SEQ ID NO: 6297 - DNA, 33 bp, homo sapien
ttaagagtgaaaaggcrattcatagaatggcat

SEQ ID NO: 6298 - DNA, 33 bp, homo sapien
gatagaagcagtcaaawgtccattgataataaa

SEQ ID NO: 6299 - DNA, 33 bp, homo sapien
cataataatgacattartccattcatgaagaca

SEQ ID NO: 6300 - DNA, 33 bp, homo sapien
ttgataatattctatcygaaagaccttggatac

SEQ ID NO: 6301 - DNA, 33 bp, homo sapien
tgaaaattgaggactgygtatcaacaaatttag

SEQ ID NO: 6302 - DNA, 33 bp, homo sapien
gtagggaaacctatgcmcgtcatgctttacttc

SEQ ID NO: 6303 - DNA, 33 bp, homo sapien
gtttatcagcatttacragctcagtgtccctag

SEQ ID NO: 6304 - DNA, 33 bp, homo sapien
ccacccttaggtgtagrttaaaactgtgcagca

SEQ ID NO: 6305 - DNA, 33 bp, homo sapien
ccacaggagcagaactktccaggccttgtatag

SEQ ID NO: 6306 - DNA, 33 bp, homo sapien
cattgaaggcaggtgcytctgctttgccgttaa

SEQ ID NO: 6307 - DNA, 33 bp, homo sapien
aataattgaggactcaygtagtaaggtgtgcca

SEQ ID NO: 6308 - DNA, 33 bp, homo sapien
ccatacacactatcttyctcattttcctgttac

SEQ ID NO: 6309 - DNA, 33 bp, homo sapien
gtcacttacagacaatygttatcttgctatgtt

SEQ ID NO: 6310 - DNA, 33 bp, homo sapien
gtctatttcagccttasagtgggagccttcagc

SEQ ID NO: 6311 - DNA, 33 bp, homo sapien
accctttgattgtatartgaatcaacattttat

SEQ ID NO: 6312 - DNA, 33 bp, homo sapien
tcagcatccatacatakgtgcattagtagctac

SEQ ID NO: 6313 - DNA, 33 bp, homo sapien
ggtttttggcagttacyctttgtcaagttaaga

SEQ ID NO: 6314 - DNA, 33 bp, homo sapien
agatgttgtcaccaccrtttcaagagggaggca

SEQ ID NO: 6315 - DNA, 33 bp, homo sapien
tgacatacttgtgcctygattccagaagtagag

SEQ ID NO: 6316 - DNA, 33 bp, homo sapien
atatttcctactagctrtaagagtgttctggtc

SEQ ID NO: 6317 - DNA, 33 bp, homo sapien
atcagtgcagatactgkgttttccgtccaacag

SEQ ID NO: 6318 - DNA, 33 bp, homo sapien
ggactgtactttaaaaytgccacaggcagtctc

SEQ ID NO: 6319 - DNA, 33 bp, homo sapien
tacaaaacagtttgcakattcctgatctaaaag

SEQ ID NO: 6320 - DNA, 33 bp, homo sapien
atgtctgcatcatgggrcacacttctgaaagca

SEQ ID NO: 6321 - DNA, 33 bp, homo sapien
agtaattttctgcattsctcaacataggagtga

SEQ ID NO: 6322 - DNA, 33 bp, homo sapien
taaatacatggtatagygccaacattcgaagta

SEQ ID NO: 6323 - DNA, 33 bp, homo sapien
caactactaacgcagtracagtacaaagatgaa

SEQ ID NO: 6324 - DNA, 33 bp, homo sapien
aataattattagatccktagcttcttaacatta

SEQ ID NO: 6325 - DNA, 33 bp, homo sapien
actgtatgttttcattygctttgttgaagatga

SEQ ID NO: 6326 - DNA, 33 bp, homo sapien
cttcatttccttttgargtagatgtttatcaga

SEQ ID NO: 6327 - DNA, 33 bp, homo sapien
tttttaattagttgaamctctcttgaatatcat

SEQ ID NO: 6328 - DNA, 33 bp, homo sapien
aatgaagtgtgaatgasaatagcacagagatgt

SEQ ID NO: 6329 - DNA, 33 bp, homo sapien
gaaacttgagtttgtcrttattgtggtgactgg

SEQ ID NO: 6330 - DNA, 33 bp, homo sapien
aggacgcctacaaataratgaataaccacatac

SEQ ID NO: 6331 - DNA, 33 bp, homo sapien
gcaagactgataaatgrgaaaacatgtcataaa

SEQ ID NO: 6332 - DNA, 33 bp, homo sapien
ctgagctctgccagatratgctctaagaaatca

SEQ ID NO: 6333 - DNA, 33 bp, homo sapien
gcatggagattgtggcrtttgggcctgggttcg

SEQ ID NO: 6334 - DNA, 33 bp, homo sapien
cacaggacactattacyaggcaaatatatgaag

SEQ ID NO: 6335 - DNA, 33 bp, homo sapien
ctttctaaaagcactamtactgtaaaacttagg

SEQ ID NO: 6336 - DNA, 33 bp, homo sapien
aatagaaatgaatagakagtgcgttgagttgtg

SEQ ID NO: 6337 - DNA, 33 bp, homo sapien
agatctgcccaagttgytgtaggtatccatagt

SEQ ID NO: 6338 - DNA, 33 bp, homo sapien
tgcactcactattcccrcagaggctgtgagtgt

SEQ ID NO: 6339 - DNA, 33 bp, homo sapien
tttgaaatttcctgggygatagaagcatctttt

SEQ ID NO: 6340 - DNA, 33 bp, homo sapien
gaggctgttattttaartggaagaacttggaaa

SEQ ID NO: 6341 - DNA, 33 bp, homo sapien
atcttaaatgccacaayaagaatgattagtgat

SEQ ID NO: 6342 - DNA, 33 bp, homo sapien
ttgcactctaatcatgrgaataattgtaaagtc

SEQ ID NO: 6343 - DNA, 33 bp, homo sapien
agagtttctgataaaasgaggagactgctggga

SEQ ID NO: 6344 - DNA, 33 bp, homo sapien
acttgaaatgtgtttawcttgaattgctctgca

SEQ ID NO: 6345 - DNA, 33 bp, homo sapien
gtatttccatcagtgtmgcctaatctactcttc

SEQ ID NO: 6346 - DNA, 33 bp, homo sapien
agaggatgtgcatttgyttagatgtttgatagc

SEQ ID NO: 6347 - DNA, 33 bp, homo sapien
cttcacttgttcagcamtttcctagctgaatag

SEQ ID NO: 6348 - DNA, 33 bp, homo sapien
attacacatctttttgratctactacacccact

SEQ ID NO: 6349 - DNA, 33 bp, homo sapien
aaaccaaaacgtgaagytcaagggatagaagat

SEQ ID NO: 6350 - DNA, 33 bp, homo sapien
cttcccctggagcttgyactttagtggaagaga

SEQ ID NO: 6351 - DNA, 33 bp, homo sapien
ggatgttaaatgtgctmcagattcttcattttt

SEQ ID NO: 6352 - DNA, 33 bp, homo sapien
tgggctttcgcaaaagktactcgctgccaaaag

SEQ ID NO: 6353 - DNA, 33 bp, homo sapien
agatggaaacagtcctsaatacccaatatgatt

SEQ ID NO: 6354 - DNA, 33 bp, homo sapien
ttcagataaaacatttkgaaagtgacagttcaa

SEQ ID NO: 6355 - DNA, 33 bp, homo sapien
tataagaccaacattcyttgttaagtgaaataa

SEQ ID NO: 6356 - DNA, 33 bp, homo sapien
tttgtctgatgaatgtmctttagaattcccttt

SEQ ID NO: 6357 - DNA, 33 bp, homo sapien
taaagatttgaagtagrtgagcaaggtggattt

SEQ ID NO: 6358 - DNA, 33 bp, homo sapien
gttgattcttcttctayggttccactaatttcc

SEQ ID NO: 6359 - DNA, 33 bp, homo sapien
tccttaattggatactytgtgggtggtttggct

SEQ ID NO: 6360 - DNA, 33 bp, homo sapien
ggattaagaataatacrtaccacatgcttggct

SEQ ID NO: 6361 - DNA, 33 bp, homo sapien
catgtgagggacctagkctgtgctccttatgag

SEQ ID NO: 6362 - DNA, 33 bp, homo sapien
tgggacctactgagtcrtaatctgcagactaac

SEQ ID NO: 6363 - DNA, 33 bp, homo sapien
ggagagagaaaaggctrgaaaacctcttcagag

SEQ ID NO: 6364 - DNA, 33 bp, homo sapien
tgagggatgaaaagaaytaaaggacataacatc

SEQ ID NO: 6365 - DNA, 33 bp, homo sapien
taactgttgtcccatgwtgaaaccctagcttga

SEQ ID NO: 6366 - DNA, 33 bp, homo sapien
aacaaccctgcagctargtagtattagcgttgt

SEQ ID NO: 6367 - DNA, 33 bp, homo sapien
agacttcatagccacgwtgtacctccttccaat

SEQ ID NO: 6368 - DNA, 33 bp, homo sapien
tctaaaaagctatattyctacatttcatttctg

SEQ ID NO: 6369 - DNA, 33 bp, homo sapien
ttgcaggggcctaaaasctagactctgctctgg

SEQ ID NO: 6370 - DNA, 33 bp, homo sapien
caggtctgagctcaaasatcccaaggtcaaatg

SEQ ID NO: 6371 - DNA, 33 bp, homo sapien
tgaagatcattgcaggraaggaagaaaccattc

SEQ ID NO: 6372 - DNA, 33 bp, homo sapien
acctgaagattaagagmcacaaaagtttgatga

SEQ ID NO: 6373 - DNA, 33 bp, homo sapien
gacatagaaaaaatcgrcatatttgactacata

SEQ ID NO: 6374 - DNA, 33 bp, homo sapien
gctgtaactcattggastctagtctcataatgt

SEQ ID NO: 6375 - DNA, 33 bp, homo sapien
tcactaagcatgttttkacctgattttcttccc

SEQ ID NO: 6376 - DNA, 33 bp, homo sapien
cctactgtccctaggcrtgaagccattgcatag

SEQ ID NO: 6377 - DNA, 33 bp, homo sapien
gggtcaactatttaagmaggctactttgcacct

SEQ ID NO: 6378 - DNA, 33 bp, homo sapien
ctcacttctgccttaaycgaagagctctttgag

SEQ ID NO: 6379 - DNA, 33 bp, homo sapien
gtcattttatatagtcratatccgtgtagactt

SEQ ID NO: 6380 - DNA, 33 bp, homo sapien
cttcctgccccctgtakagaaaagactagcaag

SEQ ID NO: 6381 - DNA, 33 bp, homo sapien
atcaaaactccagccamaaagaggagagaggag

SEQ ID NO: 6382 - DNA, 33 bp, homo sapien
ttccccagtcatctgcygtcactcagacatcat

SEQ ID NO: 6383 - DNA, 33 bp, homo sapien
tagaagttaaagctgargctatttgccagaagg

SEQ ID NO: 6384 - DNA, 33 bp, homo sapien
aaatccatcaacactgkagtagggttgtcattc

SEQ ID NO: 6385 - DNA, 33 bp, homo sapien
ttgccattaaaagtacyggcaaaaaccataatt

SEQ ID NO: 6386 - DNA, 33 bp, homo sapien
tctatcattatctttcratctcctccatatgat

SEQ ID NO: 6387 - DNA, 33 bp, homo sapien
gtcttgaagcagggtcmacactgccaggtctct

SEQ ID NO: 6388 - DNA, 33 bp, homo sapien
ggacaccttgtatgacycttagagaaaggagca

SEQ ID NO: 6389 - DNA, 33 bp, homo sapien
catattcataagggaamcataacttgcaactaa

SEQ ID NO: 6390 - DNA, 33 bp, homo sapien
gtcccagagccccttaygtggcacagctggttc

SEQ ID NO: 6391 - DNA, 33 bp, homo sapien
acaggatggtaatgttragacacaaattaacaa

SEQ ID NO: 6392 - DNA, 33 bp, homo sapien
cccatgcctcactttaytcctctgtaaagtgga

SEQ ID NO: 6393 - DNA, 33 bp, homo sapien
aacacagaatttcccaygtgtagcattcaaggg

SEQ ID NO: 6394 - DNA, 33 bp, homo sapien
acctagttagctgcacrgccagaatataaaccc

SEQ ID NO: 6395 - DNA, 33 bp, homo sapien
ttgcagagaatatggarcaacttactttgttgt

SEQ ID NO: 6396 - DNA, 33 bp, homo sapien
tgagccatgaagagtcyttcctcagcttggtct

SEQ ID NO: 6397 - DNA, 33 bp, homo sapien
tcatataagcacctaawacatcaatttctctgt

SEQ ID NO: 6398 - DNA, 33 bp, homo sapien
tcattcttggaggctgyatctgctcttctgtcc

SEQ ID NO: 6399 - DNA, 33 bp, homo sapien
tactgtgactaagatgrtacccaagttgcaaga

SEQ ID NO: 6400 - DNA, 33 bp, homo sapien
tgctatgatcattatcytatcccatttcttcct

SEQ ID NO: 6401 - DNA, 33 bp, homo sapien
gtatcaaagaccatttkactctatttgtatgtg

SEQ ID NO: 6402 - DNA, 33 bp, homo sapien
aatgggaatagaagtcrcaacatatccagttcg

SEQ ID NO: 6403 - DNA, 33 bp, homo sapien
aacttttcctcaaacakttcctgctaatgcaga

SEQ ID NO: 6404 - DNA, 33 bp, homo sapien
tcaccccaccttaaaayggacacatcctaatct

SEQ ID NO: 6405 - DNA, 33 bp, homo sapien
cctacctgcaggaagartgacctcccattccta

SEQ ID NO: 6406 - DNA, 33 bp, homo sapien
aagtctttaccagtgargtgggtgtaagagagg

SEQ ID NO: 6407 - DNA, 33 bp, homo sapien
aggtacttctcattaayatgcaatcatcaccaa

SEQ ID NO: 6408 - DNA, 33 bp, homo sapien
ctttttcacatttccgrcaaagttcttccttcc

SEQ ID NO: 6409 - DNA, 33 bp, homo sapien
ctagtgaacgagccacyttttccatgaagaggt

SEQ ID NO: 6410 - DNA, 33 bp, homo sapien
aaatctacagttaacawcatacttactgatgaa

SEQ ID NO: 6411 - DNA, 33 bp, homo sapien
tgaaaagttgaaattastccttactccatgggc

SEQ ID NO: 6412 - DNA, 33 bp, homo sapien
aagatgagtagttcagyttgtgacatggttgag

SEQ ID NO: 6413 - DNA, 33 bp, homo sapien
tcctgagaaataccaargtcctcaaagcactca

SEQ ID NO: 6414 - DNA, 33 bp, homo sapien
caatattcagtctccaraaagcaaagtcataac

SEQ ID NO: 6415 - DNA, 33 bp, homo sapien
cagaggataaattattkttttcattagctttat

SEQ ID NO: 6416 - DNA, 33 bp, homo sapien
gagtaattttcactttkaagtctttttacttaa

SEQ ID NO: 6417 - DNA, 33 bp, homo sapien
acagtcacatttcatckgcaggcactcagtctc

SEQ ID NO: 6418 - DNA, 33 bp, homo sapien
aaacgatttttctaccratcaacgaagtgccaa

SEQ ID NO: 6419 - DNA, 33 bp, homo sapien
acttgccctggagtcaytggtgtagggtctgct

SEQ ID NO: 6420 - DNA, 33 bp, homo sapien
tactgaatgcttttaaygacaccaaagtcacct

SEQ ID NO: 6421 - DNA, 33 bp, homo sapien
ctcctatccctcattcytaaccatcctcagctt

SEQ ID NO: 6422 - DNA, 33 bp, homo sapien
tggggaactccaactcrgtagccaaacacactc

SEQ ID NO: 6423 - DNA, 33 bp, homo sapien
tatgagattgagtacamcagcaactaaagggac

SEQ ID NO: 6424 - DNA, 33 bp, homo sapien
gtttataatacatttcrtctttcataatctcca

SEQ ID NO: 6425 - DNA, 33 bp, homo sapien
ggtaggtatatgtataygttaatctggaagctg

SEQ ID NO: 6426 - DNA, 33 bp, homo sapien
atttgatggtatctcaytcttgaaaatgggcca

SEQ ID NO: 6427 - DNA, 33 bp, homo sapien
atcataaagtgcatcaktataaaacaaataaag

SEQ ID NO: 6428 - DNA, 33 bp, homo sapien
aaataagtaagcataaygcaaatcgatgcagac

SEQ ID NO: 6429 - DNA, 33 bp, homo sapien
gtgtgtagtggtatctygttgttgtaatttgca

SEQ ID NO: 6430 - DNA, 33 bp, homo sapien
gctgaactcacctgatytagcacctgggtctta

SEQ ID NO: 6431 - DNA, 33 bp, homo sapien
gagtacactcaataaawcctgttaataactaat

SEQ ID NO: 6432 - DNA, 33 bp, homo sapien
ctaggggtttggagtcrtgcaaccaattcacta

SEQ ID NO: 6433 - DNA, 33 bp, homo sapien
tgctttagctcaacgtkggatgaatgccatttg

SEQ ID NO: 6434 - DNA, 33 bp, homo sapien
ttctagtttatagaagractttccatctatttc

SEQ ID NO: 6435 - DNA, 33 bp, homo sapien
tttatattcactcttasattttaactcattctg

SEQ ID NO: 6436 - DNA, 33 bp, homo sapien
attagattgaaggaagsaaaatattgttcctgg

SEQ ID NO: 6437 - DNA, 33 bp, homo sapien
agatagatgcggctacygtgggataagaaacag

SEQ ID NO: 6438 - DNA, 33 bp, homo sapien
ctttttctactgaaagrcactgaaataaaaaca

SEQ ID NO: 6439 - DNA, 33 bp, homo sapien
caggatcatgtaggtgyagacgtttagcaagct

SEQ ID NO: 6440 - DNA, 33 bp, homo sapien
tctcaaagctgattggracctttgaataaatgg

SEQ ID NO: 6441 - DNA, 33 bp, homo sapien
tagaattccttgttagkcaaaaaccttggaagt

SEQ ID NO: 6442 - DNA, 33 bp, homo sapien
cttttataggttcttaytttattgcactgaaga

SEQ ID NO: 6443 - DNA, 33 bp, homo sapien
aggacagttctgtgatytgcaaaatttcttaaa

SEQ ID NO: 6444 - DNA, 33 bp, homo sapien
cagtttcaggcatagamtaagaggcttgaattc

SEQ ID NO: 6445 - DNA, 33 bp, homo sapien
ggtaagtaataagagtsacaaccactattcttc

SEQ ID NO: 6446 - DNA, 33 bp, homo sapien
tgtggttatggtaagtyttgagagaaatgagca

SEQ ID NO: 6447 - DNA, 33 bp, homo sapien
tttccttttctaccatrcgtcacaaaccgctca

SEQ ID NO: 6448 - DNA, 33 bp, homo sapien
gttcaaaagacatgtaygagaataatcacagca

SEQ ID NO: 6449 - DNA, 33 bp, homo sapien
atcagaaaaatatagarggaaactgaaggaagt

SEQ ID NO: 6450 - DNA, 33 bp, homo sapien
agggattagtacaagtkcaaagccatgttcaat

SEQ ID NO: 6451 - DNA, 33 bp, homo sapien
catgactttctcatggyggaaggcacgggagga

SEQ ID NO: 6452 - DNA, 33 bp, homo sapien
tttctttgggtttcgckagatactctctcttaa

SEQ ID NO: 6453 - DNA, 33 bp, homo sapien
tctgatgtgcctctagktttgatcattgataca

SEQ ID NO: 6454 - DNA, 33 bp, homo sapien
tcctcaacaaaatactygaaaattgcatttgac

SEQ ID NO: 6455 - DNA, 33 bp, homo sapien
gcccagtggctgatcayactcaatttgtccagc

SEQ ID NO: 6456 - DNA, 33 bp, homo sapien
ctctcaataattcccargatgtttcagaaaggt

SEQ ID NO: 6457 - DNA, 33 bp, homo sapien
ctgaaataatgaggttytgctatgtaagtaaaa

SEQ ID NO: 6458 - DNA, 33 bp, homo sapien
atagaaatgtccaaggrttgccatttattcaac

SEQ ID NO: 6459 - DNA, 33 bp, homo sapien
acagggtgtaaaaagawaaaagcatcatcattc

SEQ ID NO: 6460 - DNA, 33 bp, homo sapien
tcattcagcttcttaamtctgtagactcatcag

SEQ ID NO: 6461 - DNA, 33 bp, homo sapien
tcaacttccaaccaccrccatctgggtgacact

SEQ ID NO: 6462 - DNA, 33 bp, homo sapien
aagtgctgtgcttcttkttgggcttaatgtttg

SEQ ID NO: 6463 - DNA, 33 bp, homo sapien
cttaatagaaacttacrcccattgattagtagc

SEQ ID NO: 6464 - DNA, 33 bp, homo sapien
atgcagatgacttcagrtacagaaatctttgtc

SEQ ID NO: 6465 - DNA, 33 bp, homo sapien
attcgaccattttaacrcatgatataaattaaa

SEQ ID NO: 6466 - DNA, 33 bp, homo sapien
caccattgagtgaattsattacccaatcctgga

SEQ ID NO: 6467 - DNA, 33 bp, homo sapien
ttctgactttccacccktttttcccttcagtct

SEQ ID NO: 6468 - DNA, 33 bp, homo sapien
agtacagcacattcccratggtgtcctctgaga

SEQ ID NO: 6469 - DNA, 33 bp, homo sapien
cctaaacagtatgtgartttctcctttaatcta

SEQ ID NO: 6470 - DNA, 33 bp, homo sapien
tgattgctatggattaytcttcatcaaatattc

SEQ ID NO: 6471 - DNA, 33 bp, homo sapien
tttaccagttctattayaacaatgtgtagctga

SEQ ID NO: 6472 - DNA, 33 bp, homo sapien
gacaaatagtcaaggargaatcagcattctgtc

SEQ ID NO: 6473 - DNA, 33 bp, homo sapien
agtcttcatacaaggcmttgaacacagaatgag

SEQ ID NO: 6474 - DNA, 33 bp, homo sapien
gatgcaagttgtagttyttctgtagattgtctt

SEQ ID NO: 6475 - DNA, 33 bp, homo sapien
caactttttcttttagytcccacacgtgagtaa

SEQ ID NO: 6476 - DNA, 33 bp, homo sapien
ccgatagtgtaaaatcractgtctcaccataaa

SEQ ID NO: 6477 - DNA, 33 bp, homo sapien
taatgatatatgtataygattgagcaggacatt

SEQ ID NO: 6478 - DNA, 33 bp, homo sapien
ccaccatgtgggaatcrgcaagaacaacaaaac

SEQ ID NO: 6479 - DNA, 33 bp, homo sapien
gtacactgtacattcawtgttttttggggtttc

SEQ ID NO: 6480 - DNA, 33 bp, homo sapien
gaattttgtagacatgrttaagagcatcttgat

SEQ ID NO: 6481 - DNA, 33 bp, homo sapien
cctcatctgccatttgyttccccgtatatgtgc

SEQ ID NO: 6482 - DNA, 33 bp, homo sapien
acttgggttctgagacrtactggtttcaggaga

SEQ ID NO: 6483 - DNA, 33 bp, homo sapien
cagaaatgcagtaggtrgtctctttctcctttc

SEQ ID NO: 6484 - DNA, 33 bp, homo sapien
cactagggccagttagyccacttactccacatt

SEQ ID NO: 6485 - DNA, 33 bp, homo sapien
ttgagagtaactgttgrgactaaggtttagaaa

SEQ ID NO: 6486 - DNA, 33 bp, homo sapien
agtcgacagttttacasaacattctgaatctta

SEQ ID NO: 6487 - DNA, 33 bp, homo sapien
gaatgtaacttccttcmaagactgcagtgtact

SEQ ID NO: 6488 - DNA, 33 bp, homo sapien
tcccccagaattcgtaygggcttagttccagga

SEQ ID NO: 6489 - DNA, 33 bp, homo sapien
aacaaataaatcaccartgaatacaaagatgaa

SEQ ID NO: 6490 - DNA, 33 bp, homo sapien
actaagacaaaaaagaycacatgtgaagaatgc

SEQ ID NO: 6491 - DNA, 33 bp, homo sapien
cttcatcttttatccawcaaagtataaagttat

SEQ ID NO: 6492 - DNA, 33 bp, homo sapien
ccaagagcgcatagtaygacagaatcagtatga

SEQ ID NO: 6493 - DNA, 33 bp, homo sapien
actccaagaacttacaygacaattttcagacag

SEQ ID NO: 6494 - DNA, 33 bp, homo sapien
aaagaaggtttgggtcrttctgtcaggtaaaat

SEQ ID NO: 6495 - DNA, 33 bp, homo sapien
ttcagacaaactgatgsacaaaaccaatggtga

SEQ ID NO: 6496 - DNA, 33 bp, homo sapien
attttcaagaatcctcrtacaaattgtccaggg

SEQ ID NO: 6497 - DNA, 33 bp, homo sapien
aattaagaaagtacaawtgtcttcctgtaaaca

SEQ ID NO: 6498 - DNA, 33 bp, homo sapien
gaaagaaaattctttcrtgggctaagctccact

SEQ ID NO: 6499 - DNA, 33 bp, homo sapien
cagtattgagccaagcwgcttaaaacaaccctt

SEQ ID NO: 6500 - DNA, 33 bp, homo sapien
caagcctccattcaacwcacaaggttaagcctt

SEQ ID NO: 6501 - DNA, 33 bp, homo sapien
tatccatgcgcagtttwaaaatttccaggaaaa

SEQ ID NO: 6502 - DNA, 33 bp, homo sapien
tatattaaactgaaaayattctgcacagcaaag

SEQ ID NO: 6503 - DNA, 33 bp, homo sapien
cctgatgcgtacctgckctaagagaagttttat

SEQ ID NO: 6504 - DNA, 33 bp, homo sapien
tcttgcctttgctaagyacctcggtagattttt

SEQ ID NO: 6505 - DNA, 33 bp, homo sapien
atttcctctccgtcatyagcctattttcagcct

SEQ ID NO: 6506 - DNA, 33 bp, homo sapien
ccaggcaacagagccaycttgaagcacagccag

SEQ ID NO: 6507 - DNA, 33 bp, homo sapien
atagaaaagtacatagkttaatgacaagtggaa

SEQ ID NO: 6508 - DNA, 33 bp, homo sapien
tgcttgccatagatagwcaatttgccttaagat

SEQ ID NO: 6509 - DNA, 33 bp, homo sapien
agaactaataccaaccrtactcaaactactctg

SEQ ID NO: 6510 - DNA, 33 bp, homo sapien
atgaagatactctcacyataggtaacttgcaga

SEQ ID NO: 6511 - DNA, 33 bp, homo sapien
tgaatatttcacagtckaattgttcataataga

SEQ ID NO: 6512 - DNA, 33 bp, homo sapien
aacaagctgaggttcasaaagtttgaggagggc

SEQ ID NO: 6513 - DNA, 33 bp, homo sapien
tcaatcattttctcacyatattgctcaaacaaa

SEQ ID NO: 6514 - DNA, 33 bp, homo sapien
ttcatgttgtgattgtrcgagtcaatactactt

SEQ ID NO: 6515 - DNA, 33 bp, homo sapien
agctccttctgttcaascagaagttctgactcc

SEQ ID NO: 6516 - DNA, 33 bp, homo sapien
ctccaggttacttcatkgtctcaaatagctatt

SEQ ID NO: 6517 - DNA, 33 bp, homo sapien
attattatactgtacawccagcaagtagagtct

SEQ ID NO: 6518 - DNA, 33 bp, homo sapien
cgtaccttgtgattccrcgagtcaacactcctt

SEQ ID NO: 6519 - DNA, 33 bp, homo sapien
ggccatggcattgtgtrtagttgctgatcatgg

SEQ ID NO: 6520 - DNA, 33 bp, homo sapien
aagataagacagtcaarttgggagcaggcatgg

SEQ ID NO: 6521 - DNA, 33 bp, homo sapien
ttctacctatcagattrtcagtaaaacaagtga

SEQ ID NO: 6522 - DNA, 33 bp, homo sapien
gtaaaagcagattttaytcaggaactattgcag

SEQ ID NO: 6523 - DNA, 33 bp, homo sapien
tccatggaacaagcagmtgatgttgtgaggggt

SEQ ID NO: 6524 - DNA, 33 bp, homo sapien
ttacactgcgtaacagyaaaccacttcaaaatc

SEQ ID NO: 6525 - DNA, 33 bp, homo sapien
ctggctgtcacctggarcttccaaactcagccc

SEQ ID NO: 6526 - DNA, 33 bp, homo sapien
gttggactggatgaaaytgaaggtcacggctaa

SEQ ID NO: 6527 - DNA, 33 bp, homo sapien
atttattttccaaagaygatttattgaaaagac

SEQ ID NO: 6528 - DNA, 33 bp, homo sapien
gctaaatgctagtggckttcagtggtttaacgt

SEQ ID NO: 6529 - DNA, 33 bp, homo sapien
attcttagcctttttgsgttctgaagtatgaaa

SEQ ID NO: 6530 - DNA, 33 bp, homo sapien
aattcaaggagctgaaragtcacaatcttttta

SEQ ID NO: 6531 - DNA, 33 bp, homo sapien
atgggcatgccagacawagagaagattcattta

SEQ ID NO: 6532 - DNA, 33 bp, homo sapien
tcaaaactattttgccrtctatcaaggtatgtt

SEQ ID NO: 6533 - DNA, 33 bp, homo sapien
gctgctgttcctctacsatttttatggcccacc

SEQ ID NO: 6534 - DNA, 33 bp, homo sapien
atctgtccactttgtgygccagaattgagcctg

SEQ ID NO: 6535 - DNA, 33 bp, homo sapien
gcaagtatatgacaacygcgacagcaactcatg

SEQ ID NO: 6536 - DNA, 33 bp, homo sapien
cttttcatattcaaatrctctgcttggttccgc

SEQ ID NO: 6537 - DNA, 33 bp, homo sapien
tattccaactaatatcrtgaaactgattttgca

SEQ ID NO: 6538 - DNA, 33 bp, homo sapien
cttccagaaggtagacrtttactctcccctcat

SEQ ID NO: 6539 - DNA, 33 bp, homo sapien
ctacatacatcttcatrgagataaaagttgtgg

SEQ ID NO: 6540 - DNA, 33 bp, homo sapien
atatttcatacacctcrtaaaaacttcagtgga

SEQ ID NO: 6541 - DNA, 33 bp, homo sapien
gaggtttaccttggacyctgacacagtagctat

SEQ ID NO: 6542 - DNA, 33 bp, homo sapien
catgacactctcaggaygctgcaagttgtgggg

SEQ ID NO: 6543 - DNA, 33 bp, homo sapien
tgtaattaaccagataytgagccttcaggaggg

SEQ ID NO: 6544 - DNA, 33 bp, homo sapien
actgaatgaataaagaygaaaggatgagtttgc

SEQ ID NO: 6545 - DNA, 33 bp, homo sapien
gtcaaggtcagaacccraggctcaattttaatc

SEQ ID NO: 6546 - DNA, 33 bp, homo sapien
ctagctatgtgacttcrgccaaatcacttgtat

SEQ ID NO: 6547 - DNA, 33 bp, homo sapien
gcatttacagtttagtyagagtcaagagcaaga

SEQ ID NO: 6548 - DNA, 33 bp, homo sapien
gactggcagggactttktttggctttgtgtgga

SEQ ID NO: 6549 - DNA, 33 bp, homo sapien
ggggactgcagtttgtytcagccaagaactaga

SEQ ID NO: 6550 - DNA, 33 bp, homo sapien
tcctaaggagacaggaracaatacagtccaacc

SEQ ID NO: 6551 - DNA, 33 bp, homo sapien
cttagcccaactgcacytatgccctgctagaaa

SEQ ID NO: 6552 - DNA, 33 bp, homo sapien
gtgtttttccttgacaygctaccgctagaccac

SEQ ID NO: 6553 - DNA, 33 bp, homo sapien
tttagacccaaaggccrtagttataaaagattc

SEQ ID NO: 6554 - DNA, 33 bp, homo sapien
tgtttcttcccagttakgagaactatttaataa

SEQ ID NO: 6555 - DNA, 33 bp, homo sapien
caaaattctaaaatatwagagtgcagttgtcat

SEQ ID NO: 6556 - DNA, 33 bp, homo sapien
ttacccagcagcacagkgaatgaggaagcagcc

SEQ ID NO: 6557 - DNA, 33 bp, homo sapien
taattgttttactcctygcttaacatctttatg

SEQ ID NO: 6558 - DNA, 33 bp, homo sapien
tccactggaatccagtrtctgcctttggtggta

SEQ ID NO: 6559 - DNA, 33 bp, homo sapien
gcctcgttcaaaatagsctgtctctggaacaca

SEQ ID NO: 6560 - DNA, 33 bp, homo sapien
atgtctctgcatggtcrttatccttttaccaca

SEQ ID NO: 6561 - DNA, 33 bp, homo sapien
atatttcagagacaacwaggcctatagtaaaaa

SEQ ID NO: 6562 - DNA, 33 bp, homo sapien
ctgccttctgctggtgrttagagctcattcgat

SEQ ID NO: 6563 - DNA, 33 bp, homo sapien
tttatttactaattttyacaatagtttgttcac

SEQ ID NO: 6564 - DNA, 33 bp, homo sapien
ctccagagccctgagasagcaaatgtctgtgtt

SEQ ID NO: 6565 - DNA, 33 bp, homo sapien
cttcttgagatcagctsatggtgtaatatgtct

SEQ ID NO: 6566 - DNA, 33 bp, homo sapien
acaattttaagtttgcygtttaggctctagcac

SEQ ID NO: 6567 - DNA, 33 bp, homo sapien
gtaggatatgacacagmaatggtaagcttgcta

SEQ ID NO: 6568 - DNA, 33 bp, homo sapien
gatcattacataagccrctggctcatctccatc

SEQ ID NO: 6569 - DNA, 33 bp, homo sapien
atggaggctccgctacrtaggcatgcttgatta

SEQ ID NO: 6570 - DNA, 33 bp, homo sapien
ctaatgggcaaatctgyagataactttgtcaaa

SEQ ID NO: 6571 - DNA, 33 bp, homo sapien
atgttgtaatattcaartgcccaactgctctga

SEQ ID NO: 6572 - DNA, 33 bp, homo sapien
tggatagggcaggactstgtacttcaggggcct

SEQ ID NO: 6573 - DNA, 33 bp, homo sapien
aatgactcaaaatcatyttcagacagctaatga

SEQ ID NO: 6574 - DNA, 33 bp, homo sapien
ctcattgtattgtgtcrggagcagctctaagaa

SEQ ID NO: 6575 - DNA, 33 bp, homo sapien
tccctgtgtcatgtctktgtccagatgtccact

SEQ ID NO: 6576 - DNA, 33 bp, homo sapien
gtcaatactttttcagytctgaagtttcataga

SEQ ID NO: 6577 - DNA, 33 bp, homo sapien
tttggaatcctcatgcyactgaagcaataggca

SEQ ID NO: 6578 - DNA, 33 bp, homo sapien
atacttgatagtaaaakactgaatgctgtttct

SEQ ID NO: 6579 - DNA, 33 bp, homo sapien
aaaatacacaccttaamacctgctgatgacttc

SEQ ID NO: 6580 - DNA, 33 bp, homo sapien
gcaggaaatagcacgtrtggctcccaggcaatc

SEQ ID NO: 6581 - DNA, 33 bp, homo sapien
gtggtccactgccgatytaaactatttcttcta

SEQ ID NO: 6582 - DNA, 33 bp, homo sapien
gggttcttgcaccatcraggattttaggacagg

SEQ ID NO: 6583 - DNA, 33 bp, homo sapien
atgctctgaaatctccrcttatctcttaacttt

SEQ ID NO: 6584 - DNA, 33 bp, homo sapien
ataagcaaataactacmatacacggacacatcc

SEQ ID NO: 6585 - DNA, 33 bp, homo sapien
cattttgaactggacawcgctaaagaggttggc

SEQ ID NO: 6586 - DNA, 33 bp, homo sapien
atataaatgtgcaaagragtaactgcgaggggg

SEQ ID NO: 6587 - DNA, 33 bp, homo sapien
tcctctaaactcattaygtttaacatgcaagac

SEQ ID NO: 6588 - DNA, 33 bp, homo sapien
ggaaagactggcaccaragttccaccagcccag

SEQ ID NO: 6589 - DNA, 33 bp, homo sapien
gttctaatgattggatrtaggttgaggggtaga

SEQ ID NO: 6590 - DNA, 33 bp, homo sapien
cagtagtctttatatcrccaaagcaccaatgtt

SEQ ID NO: 6591 - DNA, 33 bp, homo sapien
tgggagacgtgcatcaktagtaagaactgtgag

SEQ ID NO: 6592 - DNA, 33 bp, homo sapien
tgttttaccttttagcrtgaaagaaaagttatg

SEQ ID NO: 6593 - DNA, 33 bp, homo sapien
ccttagcaactctacartcctgcccactctgta

SEQ ID NO: 6594 - DNA, 33 bp, homo sapien
cctattcaatggatgtyaactttttctgctgac

SEQ ID NO: 6595 - DNA, 33 bp, homo sapien
gtcagaaatcagtaacmaagcctatatgttcca

SEQ ID NO: 6596 - DNA, 33 bp, homo sapien
cttgccacggctgctckcacgctactacagcag

SEQ ID NO: 6597 - DNA, 33 bp, homo sapien
ctctaaataggtctgtrtgtaaccacctgtatt

SEQ ID NO: 6598 - DNA, 33 bp, homo sapien
ggtgtgtaaatcattcraatccttactatgaag

SEQ ID NO: 6599 - DNA, 33 bp, homo sapien
cacatatcaaaatttgyaggatatggttgaagt

SEQ ID NO: 6600 - DNA, 33 bp, homo sapien
ttgggaaaaagctgagkgttaggagaagctgag

SEQ ID NO: 6601 - DNA, 33 bp, homo sapien
tactccacgaaatctaygcacttgtccaaagtg

SEQ ID NO: 6602 - DNA, 33 bp, homo sapien
ggcagttccaaaccaargcaaggattaaaacct

SEQ ID NO: 6603 - DNA, 33 bp, homo sapien
agctaaccaaatccaasagttcattaaaaaggt

SEQ ID NO: 6604 - DNA, 33 bp, homo sapien
gagaactcaacaaaacygatagctgagtgttcg

SEQ ID NO: 6605 - DNA, 33 bp, homo sapien
gctggaacagcaatgcrtgtggtggtgtaatga

SEQ ID NO: 6606 - DNA, 33 bp, homo sapien
gtagagagaaccgtgtrggagactcctgcagtc

SEQ ID NO: 6607 - DNA, 33 bp, homo sapien
cattacatcatttcacygtcttctcatggatgg

SEQ ID NO: 6608 - DNA, 33 bp, homo sapien
agttcctagcataatamagatacgtaggtggca

SEQ ID NO: 6609 - DNA, 33 bp, homo sapien
aggaaaactcaaggcayggtataaataaagtac

SEQ ID NO: 6610 - DNA, 33 bp, homo sapien
tatccacgaatagctcrtgaatttgttcacttt

SEQ ID NO: 6611 - DNA, 33 bp, homo sapien
gaccatagaaagaaaayggcaagctgggaaact

SEQ ID NO: 6612 - DNA, 33 bp, homo sapien
tcagagttagcttaccrctctgatacttttaac

SEQ ID NO: 6613 - DNA, 33 bp, homo sapien
caagctgcaaagctcasaactccaaaaatgccc

SEQ ID NO: 6614 - DNA, 33 bp, homo sapien
gacaacttggtatttckttcattcttagaattc

SEQ ID NO: 6615 - DNA, 33 bp, homo sapien
aaaaggaaactcaattygtgctcagcatgcgag

SEQ ID NO: 6616 - DNA, 33 bp, homo sapien
tactgacaatactgacscagttgttaactcctg

SEQ ID NO: 6617 - DNA, 33 bp, homo sapien
tcaaatcacacaatctrtctcaaataacacatt

SEQ ID NO: 6618 - DNA, 33 bp, homo sapien
cacataccctataaagyaaccatgcagtaggaa

SEQ ID NO: 6619 - DNA, 33 bp, homo sapien
tatttggagctcatttktctgacggtttttgaa

SEQ ID NO: 6620 - DNA, 33 bp, homo sapien
aattctgggccagtctstccacccagaatgtag

SEQ ID NO: 6621 - DNA, 33 bp, homo sapien
gactagaggactgtgartatcccatcagagaga

SEQ ID NO: 6622 - DNA, 33 bp, homo sapien
gctagcatcccaataayggtgtgcccttcatga

SEQ ID NO: 6623 - DNA, 33 bp, homo sapien
gcatttttttcccttaycagtccggcgttccta

SEQ ID NO: 6624 - DNA, 33 bp, homo sapien
ttgacatcagatactcygccttttgtaaaataa

SEQ ID NO: 6625 - DNA, 33 bp, homo sapien
attagtcaatactgaaycactgctcctggggga

SEQ ID NO: 6626 - DNA, 33 bp, homo sapien
catttcccaggagccaytgcaaatgatgatgat

SEQ ID NO: 6627 - DNA, 33 bp, homo sapien
gtggttacagattcaargggtatgttgtttttt

SEQ ID NO: 6628 - DNA, 33 bp, homo sapien
tttactaaacagatccygaataaagggtatgct

SEQ ID NO: 6629 - DNA, 33 bp, homo sapien
aactctgatttacaatygagaccactacagttc

SEQ ID NO: 6630 - DNA, 33 bp, homo sapien
ctcaagcatgctgaacwtggaaaccacaactct

SEQ ID NO: 6631 - DNA, 33 bp, homo sapien
cccataagtgagagccyggagaagtatctccta

SEQ ID NO: 6632 - DNA, 33 bp, homo sapien
agataagttcatcaaartagccagggaaaaatt

SEQ ID NO: 6633 - DNA, 33 bp, homo sapien
tgaagttaaaataaggyaagtgttcaaaagcat

SEQ ID NO: 6634 - DNA, 33 bp, homo sapien
aaccacagcagagaatrcatgtgtttttttgtt

SEQ ID NO: 6635 - DNA, 33 bp, homo sapien
ttttagttgtatcattraaaaaatgtcactggt

SEQ ID NO: 6636 - DNA, 33 bp, homo sapien
ttctccacaacatatcygctcctccaggacaat

SEQ ID NO: 6637 - DNA, 33 bp, homo sapien
atgatgactgtatctgkattatgtgatataaga

SEQ ID NO: 6638 - DNA, 33 bp, homo sapien
cgaataaactaagagasgatacaattttaaaaa

SEQ ID NO: 6639 - DNA, 33 bp, homo sapien
agctaatcatatttacrgatacatcgaaaaggg

SEQ ID NO: 6640 - DNA, 33 bp, homo sapien
actttctacagtgaacrttgatcacaagattga

SEQ ID NO: 6641 - DNA, 33 bp, homo sapien
acctcattggacttcarttatgcaactagtgag

SEQ ID NO: 6642 - DNA, 33 bp, homo sapien
gcacgtgtgcatgtatsatctgtttacatgtgg

SEQ ID NO: 6643 - DNA, 33 bp, homo sapien
gacggagccacattttmactccgggccagtggt

SEQ ID NO: 6644 - DNA, 33 bp, homo sapien
agtgcagtctctgtctratgatgcttcaaaaat

SEQ ID NO: 6645 - DNA, 33 bp, homo sapien
ttcttcccctggtcccrgaattaaggctgggct

SEQ ID NO: 6646 - DNA, 33 bp, homo sapien
caattatatacaatttwaaaagccttcagaaaa

SEQ ID NO: 6647 - DNA, 33 bp, homo sapien
ctaaaacactcagaagrtatttccttgggttga

SEQ ID NO: 6648 - DNA, 33 bp, homo sapien
gctctcagctggggtgytcagaggacgcctgtg

SEQ ID NO: 6649 - DNA, 33 bp, homo sapien
ttgggccttaagggaayattgtttgtaggctgg

SEQ ID NO: 6650 - DNA, 33 bp, homo sapien
aacaggtagaacatacmcatttctcatgctatg

SEQ ID NO: 6651 - DNA, 33 bp, homo sapien
atatttcttctgaaggktattctgctgttaaga

SEQ ID NO: 6652 - DNA, 33 bp, homo sapien
cctgatgttctctactygccttcataaataaga

SEQ ID NO: 6653 - DNA, 33 bp, homo sapien
accagccagtcatgcargtgaataatgtggttg

SEQ ID NO: 6654 - DNA, 33 bp, homo sapien
tgtctaataaagaggartagctacagtggctca

SEQ ID NO: 6655 - DNA, 33 bp, homo sapien
caatctgcaacaagaawcattgtccatataggt

SEQ ID NO: 6656 - DNA, 33 bp, homo sapien
tgatttatcagttcagytgcttcaaacatagaa

SEQ ID NO: 6657 - DNA, 33 bp, homo sapien
gaggaaggagatagacraggagatgaagtgcgg

SEQ ID NO: 6658 - DNA, 33 bp, homo sapien
aagttccagctcagagyacccaactaagtgaag

SEQ ID NO: 6659 - DNA, 33 bp, homo sapien
atcttttaacaaacatmattccctctcacctag

SEQ ID NO: 6660 - DNA, 33 bp, homo sapien
gagtttaactatttctrtttagccaaccataaa

SEQ ID NO: 6661 - DNA, 33 bp, homo sapien
gattgcctgtttagccyggaagttggttttaaa

SEQ ID NO: 6662 - DNA, 33 bp, homo sapien
gcaagtagagagtcatyagtaacctcagaaaaa

SEQ ID NO: 6663 - DNA, 33 bp, homo sapien
aagtctccatgagatcrcttaggaaatgagtgt

SEQ ID NO: 6664 - DNA, 33 bp, homo sapien
gctcatctgtggacctkttattttccatcactc

SEQ ID NO: 6665 - DNA, 33 bp, homo sapien
taggtggtctttaaagygatttcctgccactgg

SEQ ID NO: 6666 - DNA, 33 bp, homo sapien
cccaccttgttaggctkcttctttgcctttctg

SEQ ID NO: 6667 - DNA, 33 bp, homo sapien
gttagctaccttttcayatgtgtagttttatat

SEQ ID NO: 6668 - DNA, 33 bp, homo sapien
tgacatctattcattaytataaagttccaaaga

SEQ ID NO: 6669 - DNA, 33 bp, homo sapien
ctccagaattgccgtcyacgctaagccttttgc

SEQ ID NO: 6670 - DNA, 33 bp, homo sapien
acagaagaacaggaatwattcttcagacctgca

SEQ ID NO: 6671 - DNA, 33 bp, homo sapien
cctctgcttggaaacastataggaacaggtcca

SEQ ID NO: 6672 - DNA, 33 bp, homo sapien
ttaataccttttgaaaygtaaacaaaagaggac

SEQ ID NO: 6673 - DNA, 33 bp, homo sapien
atcccatgcttttcccrctcagctcattgtatg

SEQ ID NO: 6674 - DNA, 33 bp, homo sapien
ctcctgctcttctcttkgggcctcccgccttct

SEQ ID NO: 6675 - DNA, 33 bp, homo sapien
tgcatttgtacatcttraaaattgacattatgc

SEQ ID NO: 6676 - DNA, 33 bp, homo sapien
gtgacttctgtattccyttgcagatcctgagct

SEQ ID NO: 6677 - DNA, 33 bp, homo sapien
gtagttttccactgaaygatctttttatctgtt

SEQ ID NO: 6678 - DNA, 33 bp, homo sapien
tgctccccacattgtaygacaatcaatcctaca

SEQ ID NO: 6679 - DNA, 33 bp, homo sapien
acaacggctgtaatacrgggataataaagtatt

SEQ ID NO: 6680 - DNA, 33 bp, homo sapien
taatttgcagatacaargctggttttttttttc

SEQ ID NO: 6681 - DNA, 33 bp, homo sapien
tatttcagctgtgtcayatgccttagtttatat

SEQ ID NO: 6682 - DNA, 33 bp, homo sapien
tttcctagaattcgccrtagcatggtctatgtt

SEQ ID NO: 6683 - DNA, 33 bp, homo sapien
tggctccgacctgcacygtgctctcttcccctt

SEQ ID NO: 6684 - DNA, 33 bp, homo sapien
tcttggctgaactcttrgagaggcaggcagaca

SEQ ID NO: 6685 - DNA, 33 bp, homo sapien
attatctcttaagcgcrtaggaatctctatttg

SEQ ID NO: 6686 - DNA, 33 bp, homo sapien
gtttgcctagtcctgcraagttctgttccaaaa

SEQ ID NO: 6687 - DNA, 33 bp, homo sapien
caaaagggaacatgtayagagtggaactttgcc

SEQ ID NO: 6688 - DNA, 33 bp, homo sapien
tcaattatagaagcagsttattgaaatgaaggt

SEQ ID NO: 6689 - DNA, 33 bp, homo sapien
tagaaagactctctttraaaaatgaaaattaaa

SEQ ID NO: 6690 - DNA, 33 bp, homo sapien
gtttagtttaccgttgrattgctttatttaaac

SEQ ID NO: 6691 - DNA, 33 bp, homo sapien
tcatatctgagatttcyttctgcgcctcagact

SEQ ID NO: 6692 - DNA, 33 bp, homo sapien
ctgccaaaaacaagccragtgagtaagccaaga

SEQ ID NO: 6693 - DNA, 33 bp, homo sapien
agttgtgagcatggttytatgaaggatttgata

SEQ ID NO: 6694 - DNA, 33 bp, homo sapien
ctttttatataaggaamttgaacatctgaggat

SEQ ID NO: 6695 - DNA, 33 bp, homo sapien
agtgtaatcacagggtycctataagagaagact

SEQ ID NO: 6696 - DNA, 33 bp, homo sapien
caaagatctgaatttgmgctctagttgccacgc

SEQ ID NO: 6697 - DNA, 33 bp, homo sapien
tataacctctaccatgyttacagaatataaaat

SEQ ID NO: 6698 - DNA, 33 bp, homo sapien
ctgtgagtcaagttatyggttgacatcctcctg

SEQ ID NO: 6699 - DNA, 33 bp, homo sapien
ctgcccaagataagacsagccctactttataat

SEQ ID NO: 6700 - DNA, 33 bp, homo sapien
acagaactgatgaaacyaggaattgccatcact

SEQ ID NO: 6701 - DNA, 33 bp, homo sapien
acttgttcgtaatgctrgacacatcgccattgg

SEQ ID NO: 6702 - DNA, 33 bp, homo sapien
gagcagctgattcactyagttgaaacatctgaa

SEQ ID NO: 6703 - DNA, 33 bp, homo sapien
tctacctcctaaacatytcttgaatctatcact

SEQ ID NO: 6704 - DNA, 33 bp, homo sapien
ggtatcgaagctgaacrgcagcaggggtgcctg

SEQ ID NO: 6705 - DNA, 33 bp, homo sapien
gtggaattggaaatggratagaatagaaggctg

SEQ ID NO: 6706 - DNA, 33 bp, homo sapien
tattacaacaatgggargttaagaagaaagaaa

SEQ ID NO: 6707 - DNA, 33 bp, homo sapien
gtctttctctttatgartagcagctgttttcct

SEQ ID NO: 6708 - DNA, 33 bp, homo sapien
tttacttttcaaaagcytacattatataaaaag

SEQ ID NO: 6709 - DNA, 33 bp, homo sapien
ctcatttaattcccacrtgaactctatgcaata

SEQ ID NO: 6710 - DNA, 33 bp, homo sapien
tcatgcatggaagccaytgggttcatcctcccc

SEQ ID NO: 6711 - DNA, 33 bp, homo sapien
tgtctaccagcatcaayagtagaaagatctatg

SEQ ID NO: 6712 - DNA, 33 bp, homo sapien
ttttcttcttacttcaytgagttgatataaaaa

SEQ ID NO: 6713 - DNA, 33 bp, homo sapien
taaagggatttttgaaytgcatattttatgact

SEQ ID NO: 6714 - DNA, 33 bp, homo sapien
aattaattctaagatayagggttcaaaggagtg

SEQ ID NO: 6715 - DNA, 33 bp, homo sapien
cattatgcacccgtttwtacttggtgtcccaca

SEQ ID NO: 6716 - DNA, 33 bp, homo sapien
gccaggtagctggaatmcattggtccaaccatg

SEQ ID NO: 6717 - DNA, 33 bp, homo sapien
ccctttccacatattaygtcatttaactctttc

SEQ ID NO: 6718 - DNA, 33 bp, homo sapien
cactaaaaagtggatcrtaactggatgtcgtga

SEQ ID NO: 6719 - DNA, 33 bp, homo sapien
tttttgtaacaagcctwcctactgatgctactc

SEQ ID NO: 6720 - DNA, 33 bp, homo sapien
cataggagagttttcawcagagtagtgaaatga

SEQ ID NO: 6721 - DNA, 33 bp, homo sapien
atcaatgaatggatggmaaatccactcatgtca

SEQ ID NO: 6722 - DNA, 33 bp, homo sapien
tggatttagtagcaagraggttactggtgccct

SEQ ID NO: 6723 - DNA, 33 bp, homo sapien
tccttattacttctgcmtttactcattgaattt

SEQ ID NO: 6724 - DNA, 33 bp, homo sapien
aaaatatggctaaagaktatacaagggtgtttt

SEQ ID NO: 6725 - DNA, 33 bp, homo sapien
taaagaagagaagaaaktaccaggacttaaggc

SEQ ID NO: 6726 - DNA, 33 bp, homo sapien
ccatctcaatatcttcmcttaatcatctctgaa

SEQ ID NO: 6727 - DNA, 33 bp, homo sapien
cagagcccttgagctgyggcatctgtgctaact

SEQ ID NO: 6728 - DNA, 33 bp, homo sapien
aaatcagggattgctasttcctgtcaatcgcag

SEQ ID NO: 6729 - DNA, 33 bp, homo sapien
tggatgttaatgtggcygtctccaatcacaaat

SEQ ID NO: 6730 - DNA, 33 bp, homo sapien
tctggaccaactactaygggagtttcagatgta

SEQ ID NO: 6731 - DNA, 33 bp, homo sapien
ttcattctttttctttyagatatcagctcaaga

SEQ ID NO: 6732 - DNA, 33 bp, homo sapien
tccaactacctgctatmttcaagagacccaact

SEQ ID NO: 6733 - DNA, 33 bp, homo sapien
tcaaggcctggtcaagractagaggacttctag

SEQ ID NO: 6734 - DNA, 33 bp, homo sapien
gttgctttatctcttgsgagtacgatttcaatt

SEQ ID NO: 6735 - DNA, 33 bp, homo sapien
aaccagtttgcccatgrtgtggtggtggagcac

SEQ ID NO: 6736 - DNA, 33 bp, homo sapien
gtcaaaattactaatgsaaagtggccagtcaag

SEQ ID NO: 6737 - DNA, 33 bp, homo sapien
tagacttgtcagtttcyttatcacccaccccat

SEQ ID NO: 6738 - DNA, 33 bp, homo sapien
ggatgagcagtctaggrttctgatgaatggggt

SEQ ID NO: 6739 - DNA, 33 bp, homo sapien
gtcctctcacaatgaaygaggacatccaatgac

SEQ ID NO: 6740 - DNA, 33 bp, homo sapien
gtaatctggctcaaaarccactgcaccatcccc

SEQ ID NO: 6741 - DNA, 33 bp, homo sapien
gagtgtctccctcaggsatgtgacttttctatg

SEQ ID NO: 6742 - DNA, 33 bp, homo sapien
aggcttatagtatgcarccttatatccatcagc

SEQ ID NO: 6743 - DNA, 33 bp, homo sapien
ccaggagtagaattatkcagattgatttagctt

SEQ ID NO: 6744 - DNA, 33 bp, homo sapien
ggtggtcacatgatcartcctggtctttatacc

SEQ ID NO: 6745 - DNA, 33 bp, homo sapien
taataaaatttctctcytaaacgctggtataat

SEQ ID NO: 6746 - DNA, 33 bp, homo sapien
gctcatagtcaaacagytcatcagtgtctggca

SEQ ID NO: 6747 - DNA, 33 bp, homo sapien
tctatggatctgagtayctttagtagcacattg

SEQ ID NO: 6748 - DNA, 33 bp, homo sapien
atgtattttaaattggycattccaccttaccta

SEQ ID NO: 6749 - DNA, 33 bp, homo sapien
gctcagaccactgtgcwtttcacaaattgggcc

SEQ ID NO: 6750 - DNA, 33 bp, homo sapien
atcttagacaataggakacttttttacatacat

SEQ ID NO: 6751 - DNA, 33 bp, homo sapien
tgggttatggctagctkctgaaaccagtttcaa

SEQ ID NO: 6752 - DNA, 33 bp, homo sapien
tgtttctgtatctgaaytaattggtgatattcc

SEQ ID NO: 6753 - DNA, 33 bp, homo sapien
acttaatgaatgaataytgaccatgtgctccga

SEQ ID NO: 6754 - DNA, 33 bp, homo sapien
tttacacaattatagtytgtatgctttctattt

SEQ ID NO: 6755 - DNA, 33 bp, homo sapien
cccgatgacgagctcaytaagaagggtctggtt

SEQ ID NO: 6756 - DNA, 33 bp, homo sapien
gaaaggaaacatgtacygtacctcaccatacag

SEQ ID NO: 6757 - DNA, 33 bp, homo sapien
tttttttgcaggccttragtatggcagaaaaca

SEQ ID NO: 6758 - DNA, 33 bp, homo sapien
accaagttgtttctgtytttttgtaatctacca

SEQ ID NO: 6759 - DNA, 33 bp, homo sapien
ccataaacataaaggayaagttaggcatagagg

SEQ ID NO: 6760 - DNA, 33 bp, homo sapien
tgaacttttctaaagarttaatgtacagagcat

SEQ ID NO: 6761 - DNA, 33 bp, homo sapien
ctgaaaatggagaaagraaccatgaaccaagga

SEQ ID NO: 6762 - DNA, 33 bp, homo sapien
gataaagatgagtaaawcaaactgtagcttcca

SEQ ID NO: 6763 - DNA, 33 bp, homo sapien
aaagagttctgaattcraaggtcagaaaccatc

SEQ ID NO: 6764 - DNA, 33 bp, homo sapien
tttcctacttatgctckcatttcagtctcacat

SEQ ID NO: 6765 - DNA, 33 bp, homo sapien
cctgtgagcttctggtwgcaacagtttcatcta

SEQ ID NO: 6766 - DNA, 33 bp, homo sapien
attaatctatgcttttkagtcccaatgtggggt

SEQ ID NO: 6767 - DNA, 33 bp, homo sapien
ttgtactcaattagacwtttgtcagcacacagc

SEQ ID NO: 6768 - DNA, 33 bp, homo sapien
ttatctctggctctctyaattttgaattaaacc

SEQ ID NO: 6769 - DNA, 33 bp, homo sapien
ccttaatatcatcctcrttattatcattatcat

SEQ ID NO: 6770 - DNA, 33 bp, homo sapien
cacctgttacccaagayggttattccagatttt

SEQ ID NO: 6771 - DNA, 33 bp, homo sapien
aggttaagcaaacacarataggtttctttactt

SEQ ID NO: 6772 - DNA, 33 bp, homo sapien
ggtacatgtttgctttkgctgtcttctgtttgt

SEQ ID NO: 6773 - DNA, 33 bp, homo sapien
aatatggattcttgcamaagatagtaattcata

SEQ ID NO: 6774 - DNA, 33 bp, homo sapien
ttgcctataaatcaggyattcgaggcaatcatc

SEQ ID NO: 6775 - DNA, 33 bp, homo sapien
aacaatatggattttgwtaaggattgtgtttaa

SEQ ID NO: 6776 - DNA, 33 bp, homo sapien
ctctttttagtgtggtyatctagcttttgactg

SEQ ID NO: 6777 - DNA, 33 bp, homo sapien
ttacatcccatcaaaasataaaggtcagtttgt

SEQ ID NO: 6778 - DNA, 33 bp, homo sapien
agccatttctaccatcrtagcccaagccatttt

SEQ ID NO: 6779 - DNA, 33 bp, homo sapien
gtggttatttgattgtrttgtcttagatggcag

SEQ ID NO: 6780 - DNA, 33 bp, homo sapien
ttattttaagtatgtgyagattcaagcaattca

SEQ ID NO: 6781 - DNA, 33 bp, homo sapien
ggaattggggcattggraagtaattaggtcatg

SEQ ID NO: 6782 - DNA, 33 bp, homo sapien
acagctgctagggatayagtggattaatgcctt

SEQ ID NO: 6783 - DNA, 33 bp, homo sapien
cccctgacagtgacctrgtaacatccaaaagga

SEQ ID NO: 6784 - DNA, 33 bp, homo sapien
aagataaaagctacctmtaaagttcaatatcct

SEQ ID NO: 6785 - DNA, 33 bp, homo sapien
tttcctggttcgggctracaaattggttttcca

SEQ ID NO: 6786 - DNA, 33 bp, homo sapien
ttatctcaggagcaagycagggaagaaagcgca

SEQ ID NO: 6787 - DNA, 33 bp, homo sapien
gtacgtaccaattatamtgctgttaaaaagaat

SEQ ID NO: 6788 - DNA, 33 bp, homo sapien
tccaggtgacactgatyaccaaatcttgactgt

SEQ ID NO: 6789 - DNA, 33 bp, homo sapien
gccagattctctaattwcatgctaccaaatgtt

SEQ ID NO: 6790 - DNA, 33 bp, homo sapien
aggaggtgctcttaagsaaacgaagaacaataa

SEQ ID NO: 6791 - DNA, 33 bp, homo sapien
ggttttcacttttaagkagtttctgtatttcac

SEQ ID NO: 6792 - DNA, 33 bp, homo sapien
tcttctctcacagttayaggagctagaggtttg

SEQ ID NO: 6793 - DNA, 33 bp, homo sapien
tagcatctgttaatgtraatgtattttgggaaa

SEQ ID NO: 6794 - DNA, 33 bp, homo sapien
aagcatcattggtgcaratgcaggtattgtaac

SEQ ID NO: 6795 - DNA, 33 bp, homo sapien
caaggacacagaagctycgcaagaaacatgaca

SEQ ID NO: 6796 - DNA, 33 bp, homo sapien
agttgcctatctgtctraaagcattaggaactt

SEQ ID NO: 6797 - DNA, 33 bp, homo sapien
agatcattaaacgttayctaaaactcaaacaat

SEQ ID NO: 6798 - DNA, 33 bp, homo sapien
ttatctggcataataarctatttgggcgggatg

SEQ ID NO: 6799 - DNA, 33 bp, homo sapien
tcccctcctttggctaytttcaagatttttctc

SEQ ID NO: 6800 - DNA, 33 bp, homo sapien
tgacatagaagaatgaygagagaaacgcaatgg

SEQ ID NO: 6801 - DNA, 33 bp, homo sapien
ggaggccccagtggacrctgaattccagcctct

SEQ ID NO: 6802 - DNA, 33 bp, homo sapien
tgttttgattttttgtragactcatctcactgg

SEQ ID NO: 6803 - DNA, 33 bp, homo sapien
ttcacagttctccataygtagcttcaagaaaaa

SEQ ID NO: 6804 - DNA, 33 bp, homo sapien
ctagctgactctgtgtytctaaccgtctgtaga

SEQ ID NO: 6805 - DNA, 33 bp, homo sapien
agaaagcaaccctcaayggacggctgcagaaga

SEQ ID NO: 6806 - DNA, 33 bp, homo sapien
atgtagcatatagaatrtctgaaccgaggccaa

SEQ ID NO: 6807 - DNA, 33 bp, homo sapien
gaagccagcacatatgyaacaagaagcggctgg

SEQ ID NO: 6808 - DNA, 33 bp, homo sapien
atgttggaaggaagccratcacagggtctcaag

SEQ ID NO: 6809 - DNA, 33 bp, homo sapien
tagcagatcctgccagwttgcaccttattagca

SEQ ID NO: 6810 - DNA, 33 bp, homo sapien
ttttggagacttagccrtaaattatttaccaaa

SEQ ID NO: 6811 - DNA, 33 bp, homo sapien
gaggtgagactggttaytcctccgtgcactatc

SEQ ID NO: 6812 - DNA, 33 bp, homo sapien
ggatacaacaaaaagaratggcagtaccaagtg

SEQ ID NO: 6813 - DNA, 33 bp, homo sapien
ttcaatgagtgttggtkgatccaagtctattcc

SEQ ID NO: 6814 - DNA, 33 bp, homo sapien
tggttttctcagctagrtttcaactagagagcc

SEQ ID NO: 6815 - DNA, 33 bp, homo sapien
ttttattgtggttgtgwccatgcccgagactgc

SEQ ID NO: 6816 - DNA, 33 bp, homo sapien
gacccaggttctttctrtcttcctgacaatagt

SEQ ID NO: 6817 - DNA, 33 bp, homo sapien
gcaagcccagctaagaytagcagagactcttag

SEQ ID NO: 6818 - DNA, 33 bp, homo sapien
tctacctttagatccawcaatatttgctataca

SEQ ID NO: 6819 - DNA, 33 bp, homo sapien
gaggctagggtaatcaygacaacacaatattgg

SEQ ID NO: 6820 - DNA, 33 bp, homo sapien
tcaaaaaccaaggtagygaggttggccaatcca

SEQ ID NO: 6821 - DNA, 33 bp, homo sapien
gtgtcccctaaaaggaycagcatgttcacctgt

SEQ ID NO: 6822 - DNA, 33 bp, homo sapien
tccaaataaaaatgtcragagtatgttgtgaac

SEQ ID NO: 6823 - DNA, 33 bp, homo sapien
ctcactatcccagtttmtaagcagccctttttt

SEQ ID NO: 6824 - DNA, 33 bp, homo sapien
ttgccatttgttgagcrttggcaataagtcaga

SEQ ID NO: 6825 - DNA, 33 bp, homo sapien
atgtaggaagactctayaaggacatggcatgga

SEQ ID NO: 6826 - DNA, 33 bp, homo sapien
ctgtagcacatcatcamctgtgtaatagtttgg

SEQ ID NO: 6827 - DNA, 33 bp, homo sapien
tggcctctcctaccacrcataacgccaagggga

SEQ ID NO: 6828 - DNA, 33 bp, homo sapien
ctcctggtgacagtgcratcaaaaattataagt

SEQ ID NO: 6829 - DNA, 33 bp, homo sapien
atgaaattaaccaaccstggatattagtatagc

SEQ ID NO: 6830 - DNA, 33 bp, homo sapien
tatttcttaaaagccaygacatagaacaaccag

SEQ ID NO: 6831 - DNA, 33 bp, homo sapien
aagttgggccagtttcygattccttttcctcat

SEQ ID NO: 6832 - DNA, 33 bp, homo sapien
cattactgtcaagtttyttattccatgtttaat

SEQ ID NO: 6833 - DNA, 33 bp, homo sapien
ataggcagctgctacaytacagcgccacacagg

SEQ ID NO: 6834 - DNA, 33 bp, homo sapien
aacaaaaatgcaaataytatcatcgtaaattat

SEQ ID NO: 6835 - DNA, 33 bp, homo sapien
cttgagtgatccctgcrgtattgtttctactag

SEQ ID NO: 6836 - DNA, 33 bp, homo sapien
caggtgtaagcagaaawgaggatctactggtga

SEQ ID NO: 6837 - DNA, 33 bp, homo sapien
actagttgatgccaatygatactctgacaagga

SEQ ID NO: 6838 - DNA, 33 bp, homo sapien
atcatgtacctaattayatcattgcaattgtgg

SEQ ID NO: 6839 - DNA, 33 bp, homo sapien
ccagttccattctgcayttggtggccacaaatc

SEQ ID NO: 6840 - DNA, 33 bp, homo sapien
ctcagcctccatcaatrttagagaaatgcaaat

SEQ ID NO: 6841 - DNA, 33 bp, homo sapien
tttactgaatttttgtyaaatataggaaataca

SEQ ID NO: 6842 - DNA, 33 bp, homo sapien
caagacacaaaagatcrtctataaaccgtaata

SEQ ID NO: 6843 - DNA, 33 bp, homo sapien
ttgtcatttttcatgaygaactttgaggataag

SEQ ID NO: 6844 - DNA, 33 bp, homo sapien
ttagaactgtctgtatkttaactactttgtcaa

SEQ ID NO: 6845 - DNA, 33 bp, homo sapien
tatttttatagcttggyggtatgtttgtagtga

SEQ ID NO: 6846 - DNA, 33 bp, homo sapien
ctttgttggattgactyaaactcttttaaatac

SEQ ID NO: 6847 - DNA, 33 bp, homo sapien
caagctggaaccacacraaaagcttagcaaatg

SEQ ID NO: 6848 - DNA, 33 bp, homo sapien
agaggaagccaagagamaactcatttcagtttc

SEQ ID NO: 6849 - DNA, 33 bp, homo sapien
ctggactaggttcctamgagcaaggaagttatg

SEQ ID NO: 6850 - DNA, 33 bp, homo sapien
atgaaagagaggacatygctactattattacag

SEQ ID NO: 6851 - DNA, 33 bp, homo sapien
tctaacatgttacatasaccatgagaatgagaa

SEQ ID NO: 6852 - DNA, 33 bp, homo sapien
tgggctccccaggcaamaagaaggcataataat

SEQ ID NO: 6853 - DNA, 33 bp, homo sapien
agaccacctagaaaaaygggacactctggccca

SEQ ID NO: 6854 - DNA, 33 bp, homo sapien
tcatggagctgcgttcragggatgcactgaccc

SEQ ID NO: 6855 - DNA, 33 bp, homo sapien
aaagccttccacactayatgactggtagacttg

SEQ ID NO: 6856 - DNA, 33 bp, homo sapien
taataatgagtatgccytaaaattgtgtgtatt

SEQ ID NO: 6857 - DNA, 33 bp, homo sapien
attttacacataactcrtagggttttcatgata

SEQ ID NO: 6858 - DNA, 33 bp, homo sapien
caggattccaacacgarcacaatgtatttgtat

SEQ ID NO: 6859 - DNA, 33 bp, homo sapien
gtttccttcaagtcttkgagcatgcttataata

SEQ ID NO: 6860 - DNA, 33 bp, homo sapien
ctgtctatttaactcarcttccttccctgcctt

SEQ ID NO: 6861 - DNA, 33 bp, homo sapien
gctggcacattctcagygtttaatgcctaacta

SEQ ID NO: 6862 - DNA, 33 bp, homo sapien
tggttgctttatctccmatgtcacttttaacaa

SEQ ID NO: 6863 - DNA, 33 bp, homo sapien
agcagaaggccacctgkcaggaatccctcttcc

SEQ ID NO: 6864 - DNA, 33 bp, homo sapien
catccgtcagaccaagratttaaaaatagatac

SEQ ID NO: 6865 - DNA, 33 bp, homo sapien
agactgcattatatcartttttctacatgttgc

SEQ ID NO: 6866 - DNA, 33 bp, homo sapien
gtcaattactatgtaakgttactcaagggttta

SEQ ID NO: 6867 - DNA, 33 bp, homo sapien
gtttttttgggaggtartgcaagaaaacagcag

SEQ ID NO: 6868 - DNA, 33 bp, homo sapien
attgttttgcctatcaygaggccctggtatttc

SEQ ID NO: 6869 - DNA, 33 bp, homo sapien
acacacacatgctgtgrgaccacaaggccatta

SEQ ID NO: 6870 - DNA, 33 bp, homo sapien
atcaaagcaacgtatcraaagctatgggataca

SEQ ID NO: 6871 - DNA, 33 bp, homo sapien
ctcttatgggaatctaktcaggactctcagagt

SEQ ID NO: 6872 - DNA, 33 bp, homo sapien
ttaagtaaaaagagacrggtaaatcgaatttta

SEQ ID NO: 6873 - DNA, 33 bp, homo sapien
caggtgggcagtagtcrtattaaaagtgtctga

SEQ ID NO: 6874 - DNA, 33 bp, homo sapien
taaagtaaccaccagamaaataaattgatgatt

SEQ ID NO: 6875 - DNA, 33 bp, homo sapien
ccagaactatagatacraattcaggaaagcatc

SEQ ID NO: 6876 - DNA, 33 bp, homo sapien
atcccacaaaggaggcytttccttggttgacag

SEQ ID NO: 6877 - DNA, 33 bp, homo sapien
gtgtctgttaaccaatytctgactattcacacc

SEQ ID NO: 6878 - DNA, 33 bp, homo sapien
gaaaggttgttagattstaaatttactacttca

SEQ ID NO: 6879 - DNA, 33 bp, homo sapien
cagcacccgaatttcayatcccaggaaactctt

SEQ ID NO: 6880 - DNA, 33 bp, homo sapien
cagtaaaaagtcttccyatggcttctcttatct

SEQ ID NO: 6881 - DNA, 33 bp, homo sapien
aaggacccagcagtccragaacttgcccaccta

SEQ ID NO: 6882 - DNA, 33 bp, homo sapien
ttgtcactgtattaagygtccagtcagataatc

SEQ ID NO: 6883 - DNA, 33 bp, homo sapien
aacatcatttacttttsgtcatgctggatttgg

SEQ ID NO: 6884 - DNA, 33 bp, homo sapien
tgacctaatcgggacarttgtgaaagtcttcaa

SEQ ID NO: 6885 - DNA, 33 bp, homo sapien
tgaagaatctgctcctygaagtagggaccttaa

SEQ ID NO: 6886 - DNA, 33 bp, homo sapien
agagtctttgcacccamaactccaaactgcatc

SEQ ID NO: 6887 - DNA, 33 bp, homo sapien
ttagaccacccctagcyagaaaaaaattgtcca

SEQ ID NO: 6888 - DNA, 33 bp, homo sapien
ctagctctgtaaatggycaaacaaccatatcta

SEQ ID NO: 6889 - DNA, 33 bp, homo sapien
tttaaaggagacagttracaaatccactattag

SEQ ID NO: 6890 - DNA, 33 bp, homo sapien
gaagagaagattcctcrggtgaaaaatttctgg

SEQ ID NO: 6891 - DNA, 33 bp, homo sapien
tctgaaatgcctattakatagttgtggagcttc

SEQ ID NO: 6892 - DNA, 33 bp, homo sapien
taaatcttttagtcaartgtatcaaactccctg

SEQ ID NO: 6893 - DNA, 33 bp, homo sapien
ccctgtcctctccactrtgtttctaaaactttc

SEQ ID NO: 6894 - DNA, 33 bp, homo sapien
caatgttaattccatgrttttgacaagtgcacc

SEQ ID NO: 6895 - DNA, 33 bp, homo sapien
aattaaggcatcataasttattaacagtgattt

SEQ ID NO: 6896 - DNA, 33 bp, homo sapien
aaactctgcttgcctgrgattggtaccagctgg

SEQ ID NO: 6897 - DNA, 33 bp, homo sapien
tcactgagacaggtgcrtatctgattgcctcct

SEQ ID NO: 6898 - DNA, 33 bp, homo sapien
tctactttctacagttytgatttcattctctga

SEQ ID NO: 6899 - DNA, 33 bp, homo sapien
ggcaaatgcatgtgaarcactactgaatgaaaa

SEQ ID NO: 6900 - DNA, 33 bp, homo sapien
atgctgaattaacttgytgatgtactgttgaat

SEQ ID NO: 6901 - DNA, 33 bp, homo sapien
agctgagtcatttttawttctctgagccacaat

SEQ ID NO: 6902 - DNA, 33 bp, homo sapien
tgctagaaatacctgcmcgtcatttctacttct

SEQ ID NO: 6903 - DNA, 33 bp, homo sapien
cattgtgttttctcaaygattcaacctaacagg

SEQ ID NO: 6904 - DNA, 33 bp, homo sapien
tgaagtaatttacccawcatcacatagctaggg

SEQ ID NO: 6905 - DNA, 33 bp, homo sapien
gtaaatatacccagatrcagctgcagaacagag

SEQ ID NO: 6906 - DNA, 33 bp, homo sapien
ataatagcaggatatakggttcagtctagcatg

SEQ ID NO: 6907 - DNA, 33 bp, homo sapien
gctttttatccagaggygtggacttagtactcc

SEQ ID NO: 6908 - DNA, 33 bp, homo sapien
caatggcttatgtgacytatgagacagcataga

SEQ ID NO: 6909 - DNA, 33 bp, homo sapien
atttcaaaggccagggygatccaagctgatatt

SEQ ID NO: 6910 - DNA, 33 bp, homo sapien
cattcagacaaactacmtgactggcttctccaa

SEQ ID NO: 6911 - DNA, 33 bp, homo sapien
ctctccatgtttaaaawcaaagccttgaagtgc

SEQ ID NO: 6912 - DNA, 33 bp, homo sapien
acaaacatcaaacacartgctccgctctattcc

SEQ ID NO: 6913 - DNA, 33 bp, homo sapien
ttcattccatgtatccmtcttaattctgccatc

SEQ ID NO: 6914 - DNA, 33 bp, homo sapien
atcctgagcgtaacccrctccacttccaaagcc

SEQ ID NO: 6915 - DNA, 33 bp, homo sapien
agtgtttgtgtttaggytgtagctggccccttc

SEQ ID NO: 6916 - DNA, 33 bp, homo sapien
aaggtcctaactaaacrgctccatagtggggag

SEQ ID NO: 6917 - DNA, 33 bp, homo sapien
actaataagacactcaycgtaaagatcagtaaa

SEQ ID NO: 6918 - DNA, 33 bp, homo sapien
actcagcaatttcactkcttagaacttaataga

SEQ ID NO: 6919 - DNA, 33 bp, homo sapien
tgtcttgtaatttcagyagaaaaatctaactca

SEQ ID NO: 6920 - DNA, 33 bp, homo sapien
gctgctaaacatctgckacggtttggatatggt

SEQ ID NO: 6921 - DNA, 33 bp, homo sapien
atggtatgctgggtgaytatgtaatctgaactt

SEQ ID NO: 6922 - DNA, 33 bp, homo sapien
gatggaatgtaaattgyatctcgacaaaacttt

SEQ ID NO: 6923 - DNA, 33 bp, homo sapien
gtcttcaccgtggaccyttcatgttaatcccat

SEQ ID NO: 6924 - DNA, 33 bp, homo sapien
aggaaggtgtggcccaragtcccaatctaggtg

SEQ ID NO: 6925 - DNA, 33 bp, homo sapien
ccaggccttcttccttrgaaaacaaaaccactg

SEQ ID NO: 6926 - DNA, 33 bp, homo sapien
tacttcagcttccccartcactgataactgctt

SEQ ID NO: 6927 - DNA, 33 bp, homo sapien
ggtactaagtgtaacargtagtgtgctgataag

SEQ ID NO: 6928 - DNA, 33 bp, homo sapien
gattctggaaaccactmtaatagctctaagatt

SEQ ID NO: 6929 - DNA, 33 bp, homo sapien
ggctattatgaataacscatctgtggacactgg

SEQ ID NO: 6930 - DNA, 33 bp, homo sapien
aggtctaaagggttctrgtccaattcactaatg

SEQ ID NO: 6931 - DNA, 33 bp, homo sapien
tggaggggacattctaygactctctaagtgtat

SEQ ID NO: 6932 - DNA, 33 bp, homo sapien
caaaactttctactcckaagctgttttattttc

SEQ ID NO: 6933 - DNA, 33 bp, homo sapien
cagctcacaggaaccayggcctcagcacaaact

SEQ ID NO: 6934 - DNA, 33 bp, homo sapien
tcatttgggagtttctmctgctctgatagcacc

SEQ ID NO: 6935 - DNA, 33 bp, homo sapien
agtcatctgtgctgatygttgtagtgtgaggaa

SEQ ID NO: 6936 - DNA, 33 bp, homo sapien
tgaacatcagcactagscaggcagtatttgctg

SEQ ID NO: 6937 - DNA, 33 bp, homo sapien
tccgaattctgcttccrttgccacatcttcgtg

SEQ ID NO: 6938 - DNA, 33 bp, homo sapien
taagcaagtggcctcaycctggacgctgggcct

SEQ ID NO: 6939 - DNA, 33 bp, homo sapien
tgcatgtgtgtcttctytggaaatgtgtctgta

SEQ ID NO: 6940 - DNA, 33 bp, homo sapien
taactcaaggataattraagcatgagctcaggc

SEQ ID NO: 6941 - DNA, 33 bp, homo sapien
agtactgtttaatagcrggttaagatgaaacat

SEQ ID NO: 6942 - DNA, 33 bp, homo sapien
tgcattttttaggatcrgttgtccttgtgcctg

SEQ ID NO: 6943 - DNA, 33 bp, homo sapien
tattgactgcagtttayacttttctctgaagtg

SEQ ID NO: 6944 - DNA, 33 bp, homo sapien
actgcactgcctagctracacaggaaattacct

SEQ ID NO: 6945 - DNA, 33 bp, homo sapien
ccctacatcatttaggygtctaaaggtgacact

SEQ ID NO: 6946 - DNA, 33 bp, homo sapien
tctgaatctccaaacamtgatacatttagagtt

SEQ ID NO: 6947 - DNA, 33 bp, homo sapien
tggagggtccagccatktcatcgaatcgtcttt

SEQ ID NO: 6948 - DNA, 33 bp, homo sapien
aatgtgctatgagagcrccaaattatctacaac

SEQ ID NO: 6949 - DNA, 33 bp, homo sapien
agcaacctcattaagawggtggaacaggaagcc

SEQ ID NO: 6950 - DNA, 33 bp, homo sapien
ttaggattcaaatgacmcattcattgagatagt

SEQ ID NO: 6951 - DNA, 33 bp, homo sapien
gtactcctcaaagaagkttcagttggatatcaa

SEQ ID NO: 6952 - DNA, 33 bp, homo sapien
tggatcaccaagagtcractatagatcttttaa

SEQ ID NO: 6953 - DNA, 33 bp, homo sapien
aagactctctcctccaygttactttgattataa

SEQ ID NO: 6954 - DNA, 33 bp, homo sapien
gtaacaggattatctcrtgattaaattattgct

SEQ ID NO: 6955 - DNA, 33 bp, homo sapien
ctcaggttggggattakctctctcaggacattt

SEQ ID NO: 6956 - DNA, 33 bp, homo sapien
tgcggatgtctactgartctaaaggaatgctca

SEQ ID NO: 6957 - DNA, 33 bp, homo sapien
ttaggttgaactgatgmtgtggtttctttagca

SEQ ID NO: 6958 - DNA, 33 bp, homo sapien
gccggtggcttcatatmaacaagtgaggcactt

SEQ ID NO: 6959 - DNA, 33 bp, homo sapien
agtttaatatgacagasggtaagaaaataacat

SEQ ID NO: 6960 - DNA, 33 bp, homo sapien
tcatcttctcccacaartctgtctttagcggaa

SEQ ID NO: 6961 - DNA, 33 bp, homo sapien
gaagtctgatttaaaastatttatgcagcactt

SEQ ID NO: 6962 - DNA, 33 bp, homo sapien
aagagggagaggacaarggtgtaaagtcagact

SEQ ID NO: 6963 - DNA, 33 bp, homo sapien
aggcaggttcttctggrcactagattaattatc

SEQ ID NO: 6964 - DNA, 33 bp, homo sapien
ctagactcatgcctgtwaagtttctcattcaac

SEQ ID NO: 6965 - DNA, 33 bp, homo sapien
gaacacaggcctcggcygctgagggtctgcttt

SEQ ID NO: 6966 - DNA, 33 bp, homo sapien
agtgttaaatatcctgwtaagttcacagtactg

SEQ ID NO: 6967 - DNA, 33 bp, homo sapien
tatcagttaggatctarcctcttcctacaaggc

SEQ ID NO: 6968 - DNA, 33 bp, homo sapien
ctctagtactaggtacstgtcctgagcatgcag

SEQ ID NO: 6969 - DNA, 33 bp, homo sapien
tacatgctgcaaaaacmtctctcctggagtccc

SEQ ID NO: 6970 - DNA, 33 bp, homo sapien
ttaagccaccaagttcrtgttaatctattatag

SEQ ID NO: 6971 - DNA, 33 bp, homo sapien
gtcatggaaaatatgcygtgactagtcacagac

SEQ ID NO: 6972 - DNA, 33 bp, homo sapien
tcacttcctcatgatasaatggcatgccccaca

SEQ ID NO: 6973 - DNA, 33 bp, homo sapien
ttccatcatggtatgasctctgtttacctctcc

SEQ ID NO: 6974 - DNA, 33 bp, homo sapien
cacaacttggttttatrcattgaaggagacatg

SEQ ID NO: 6975 - DNA, 33 bp, homo sapien
gtgtggagggtgtaaayagtacctgacaaaata

SEQ ID NO: 6976 - DNA, 33 bp, homo sapien
tgctattctcttggtgyctctgtcacattgcct

SEQ ID NO: 6977 - DNA, 33 bp, homo sapien
atcacgttcttcttttmtcttgccacagctata

SEQ ID NO: 6978 - DNA, 33 bp, homo sapien
tctacctctcttaatgragaaaatgagaaatat

SEQ ID NO: 6979 - DNA, 33 bp, homo sapien
ccagatcatgagcgtastagaggctatggcatg

SEQ ID NO: 6980 - DNA, 33 bp, homo sapien
gtctaacacatgttttrtgagcatatgcatacc

SEQ ID NO: 6981 - DNA, 33 bp, homo sapien
ggggcaagaagcccagygccagggtaggaagga

SEQ ID NO: 6982 - DNA, 33 bp, homo sapien
catgaagttttaaatamggaacacaatgaccaa

SEQ ID NO: 6983 - DNA, 33 bp, homo sapien
ctgctgcatgccggttrcgtcctcactgttgtt

SEQ ID NO: 6984 - DNA, 33 bp, homo sapien
ctaggttaatggctacraaacattttaaagcct

SEQ ID NO: 6985 - DNA, 33 bp, homo sapien
ttgttgtgccattcacygaatataaagcagtcc

SEQ ID NO: 6986 - DNA, 33 bp, homo sapien
aacagagtgaggacagragtaagggaatgagag

SEQ ID NO: 6987 - DNA, 33 bp, homo sapien
gttttcatcagtaattmcaacatggaaaacaaa

SEQ ID NO: 6988 - DNA, 33 bp, homo sapien
atattgaactctgatayaggatattttactatt

SEQ ID NO: 6989 - DNA, 33 bp, homo sapien
ctctattttggttctargccaacctatgacctc

SEQ ID NO: 6990 - DNA, 33 bp, homo sapien
aataccatacacatacrgaaaagtgcatgaatc

SEQ ID NO: 6991 - DNA, 33 bp, homo sapien
ggatccaccaaccaggycaaaataaacagcagt

SEQ ID NO: 6992 - DNA, 33 bp, homo sapien
cctgccccacactgaasagttcattcttacaag

SEQ ID NO: 6993 - DNA, 33 bp, homo sapien
actcctgacatccttgygaagtatttgtccatt

SEQ ID NO: 6994 - DNA, 33 bp, homo sapien
ttattgatgtctgaatygattggcagtaaatgg

SEQ ID NO: 6995 - DNA, 33 bp, homo sapien
gtcaggaaaatgataasagagtaccctggaaaa

SEQ ID NO: 6996 - DNA, 33 bp, homo sapien
acctaacaagttgtcaraaattaacagtaatgg

SEQ ID NO: 6997 - DNA, 33 bp, homo sapien
gggtgcaaaagtggcgytttctgctctgaggct

SEQ ID NO: 6998 - DNA, 33 bp, homo sapien
ggttctaaggctcttgytggaaaccataatcag

SEQ ID NO: 6999 - DNA, 33 bp, homo sapien
tgtctgtgagaagaagsctgaagggtgagctaa

SEQ ID NO: 7000 - DNA, 33 bp, homo sapien
cacgagattgttaacaygtgtgaggagattgta

SEQ ID NO: 7001 - DNA, 33 bp, homo sapien
tgactgagaccattcaytttcctttaattcaat

SEQ ID NO: 7002 - DNA, 33 bp, homo sapien
ggaaaaaaacacagagkcaggtcccgtgtaagc

SEQ ID NO: 7003 - DNA, 33 bp, homo sapien
tatcttaaattcagtcrgagcggaaaaaacaga

SEQ ID NO: 7004 - DNA, 33 bp, homo sapien
gtgtggaggcacgcatrtgcggtagttctagct

SEQ ID NO: 7005 - DNA, 33 bp, homo sapien
aggcccaggaaagtccrtggagaagcccacact

SEQ ID NO: 7006 - DNA, 33 bp, homo sapien
ggacaaagtgacctcaraatcaacccacaagta

SEQ ID NO: 7007 - DNA, 33 bp, homo sapien
gtcattcagatctccaygtcctactaagaaact

SEQ ID NO: 7008 - DNA, 33 bp, homo sapien
ctgacattttgagccarataaccctttgctgtg

SEQ ID NO: 7009 - DNA, 33 bp, homo sapien
aactaggttgagtcagrgattgcttctaaactt

SEQ ID NO: 7010 - DNA, 33 bp, homo sapien
gaggggcagtgtccagsaatggataaggatgtg

SEQ ID NO: 7011 - DNA, 33 bp, homo sapien
agatatatagtacctcrcgcattatgactgtcc

SEQ ID NO: 7012 - DNA, 33 bp, homo sapien
tggtctgaattaattargccttgagacagacca

SEQ ID NO: 7013 - DNA, 33 bp, homo sapien
atggatgcaagggtaaraaataaacaagtcaga

SEQ ID NO: 7014 - DNA, 33 bp, homo sapien
tcttttgggtcatggtkttttagtctttgagaa

SEQ ID NO: 7015 - DNA, 33 bp, homo sapien
gttgccttctaatttgsgccaaaatctctgacc

SEQ ID NO: 7016 - DNA, 33 bp, homo sapien
ttatgttgaacttttgygttccttcttggatag

SEQ ID NO: 7017 - DNA, 33 bp, homo sapien
ccacagcagtcttgctrtcgagtcctcggaccc

SEQ ID NO: 7018 - DNA, 33 bp, homo sapien
ctggtagaggaaataayatgcctaaaagaataa

SEQ ID NO: 7019 - DNA, 33 bp, homo sapien
ggccatttatcagtccrtgagtaatactgcttt

SEQ ID NO: 7020 - DNA, 33 bp, homo sapien
taccaagaagaaaatamaagttggcattagcaa

SEQ ID NO: 7021 - DNA, 33 bp, homo sapien
cttaaggcttctgagtrccttagcctttcttag

SEQ ID NO: 7022 - DNA, 33 bp, homo sapien
cccatgtgaatgctttmtagttagttgagaata

SEQ ID NO: 7023 - DNA, 33 bp, homo sapien
ggagtcacttatgtcasatttctctcactgtta

SEQ ID NO: 7024 - DNA, 33 bp, homo sapien
ctattgagcagaattcyggagttgagggtgcta

SEQ ID NO: 7025 - DNA, 33 bp, homo sapien
taccatttctccatttyattctagttgctgggt

SEQ ID NO: 7026 - DNA, 33 bp, homo sapien
ccgagtggctgcaatawgctattaaagatgtcg

SEQ ID NO: 7027 - DNA, 33 bp, homo sapien
atgaaattactatatawtagaactgcagccttc

SEQ ID NO: 7028 - DNA, 33 bp, homo sapien
aagtaagaaaaatgctstagtctcattcttgaa

SEQ ID NO: 7029 - DNA, 33 bp, homo sapien
atcaatattgtcaaaasggccatactaccaaga

SEQ ID NO: 7030 - DNA, 33 bp, homo sapien
attttcttaaaattttrtggatacgaattcaga

SEQ ID NO: 7031 - DNA, 33 bp, homo sapien
ggagacacacacaaaawtgtcaatagaggcatg

SEQ ID NO: 7032 - DNA, 33 bp, homo sapien
cctcaatttgcaatcartcaccaagttctgcta

SEQ ID NO: 7033 - DNA, 33 bp, homo sapien
tctgtgggaaaactccyaattgcataagaccgt

SEQ ID NO: 7034 - DNA, 33 bp, homo sapien
attagaaggttaaattrtaggtcaagaatgaat

SEQ ID NO: 7035 - DNA, 33 bp, homo sapien
tcttctcttggaacttkttcttattagactctc

SEQ ID NO: 7036 - DNA, 33 bp, homo sapien
gggagacatttgcttcrccttctgttttcaaat

SEQ ID NO: 7037 - DNA, 33 bp, homo sapien
ccctcaaacattcttcrttatgatcctcatgta

SEQ ID NO: 7038 - DNA, 33 bp, homo sapien
cagtcaggattttctcrttgcctggctggtgtt

SEQ ID NO: 7039 - DNA, 33 bp, homo sapien
tagggatggggtttgawctcatctctgaaaatc

SEQ ID NO: 7040 - DNA, 33 bp, homo sapien
attatcacttacaattwttactaggtgcttctt

SEQ ID NO: 7041 - DNA, 33 bp, homo sapien
tttcaagtgtacactgyagcattgttgactgta

SEQ ID NO: 7042 - DNA, 33 bp, homo sapien
tttgtaaagccttgaasaagaaagcaagttcgg

SEQ ID NO: 7043 - DNA, 33 bp, homo sapien
aatgcatgagaaatggyctctccgtgagctagt

SEQ ID NO: 7044 - DNA, 33 bp, homo sapien
tgccattaaattgcacraaatatcaaaatacag

SEQ ID NO: 7045 - DNA, 33 bp, homo sapien
tcctaatagccatggcrtattgtagtcctatac

SEQ ID NO: 7046 - DNA, 33 bp, homo sapien
accacagccagacttayatttagtagaattttc

SEQ ID NO: 7047 - DNA, 33 bp, homo sapien
taaatggcaaatactgygtttcatcccagcaac

SEQ ID NO: 7048 - DNA, 33 bp, homo sapien
gaagagatagataaaakgaggaatccctacccc

SEQ ID NO: 7049 - DNA, 33 bp, homo sapien
tctgtaaatgagtttcrgaagagttgttatttt

SEQ ID NO: 7050 - DNA, 33 bp, homo sapien
gcaaagagcaaccaggragctgtgagctttata

SEQ ID NO: 7051 - DNA, 33 bp, homo sapien
cacatccctgacaaaamcttagccaatgtgaag

SEQ ID NO: 7052 - DNA, 33 bp, homo sapien
gtggaggctcctttacmatgtggccatcttcag

SEQ ID NO: 7053 - DNA, 33 bp, homo sapien
cagtactttttgccatycactctattttcctcc

SEQ ID NO: 7054 - DNA, 33 bp, homo sapien
agaagtagtaaaaggaratctgtgggattctgc

SEQ ID NO: 7055 - DNA, 33 bp, homo sapien
cacataaaccaacaatyctgcttctttctgtgt

SEQ ID NO: 7056 - DNA, 33 bp, homo sapien
gtggagcaaataaaacygatacaagcaattatt

SEQ ID NO: 7057 - DNA, 33 bp, homo sapien
cctttgtaaacatatgycctgcagtaaacatat

SEQ ID NO: 7058 - DNA, 33 bp, homo sapien
gcctcggtgcaaatatracaatagatttcagag

SEQ ID NO: 7059 - DNA, 33 bp, homo sapien
aagttgcctgaggagayaaaaagaaaggaatcc

SEQ ID NO: 7060 - DNA, 33 bp, homo sapien
ccaaaacagttactttsggacagtctatgccaa

SEQ ID NO: 7061 - DNA, 33 bp, homo sapien
taaggaatgatttgtgycactaagaaacaatct

SEQ ID NO: 7062 - DNA, 33 bp, homo sapien
catgcattcatttacasttactgacaacagaac

SEQ ID NO: 7063 - DNA, 33 bp, homo sapien
gctgcagtaaatgtgcraaagagacaggtgcag

SEQ ID NO: 7064 - DNA, 33 bp, homo sapien
gatttgtagaggtttaraaatatactaggggaa

SEQ ID NO: 7065 - DNA, 33 bp, homo sapien
taagatggaaattttgstgtgagaatgtcagta

SEQ ID NO: 7066 - DNA, 33 bp, homo sapien
tacattctggcagctargtacctatttttcatg

SEQ ID NO: 7067 - DNA, 33 bp, homo sapien
tccccagctttatcaaygggtccaaagttcctt

SEQ ID NO: 7068 - DNA, 33 bp, homo sapien
gttcctttaaagctcaygtctgtagaagcgcat

SEQ ID NO: 7069 - DNA, 33 bp, homo sapien
aaatggaacccttgcayagtgttagtgggcatg

SEQ ID NO: 7070 - DNA, 33 bp, homo sapien
ccagactgatgagattyttcatggtgcattcag

SEQ ID NO: 7071 - DNA, 33 bp, homo sapien
gttcctctaatggctcrtggggaaaaacaatct

SEQ ID NO: 7072 - DNA, 33 bp, homo sapien
tattaacccattctcakgctgttatgaagaaat

SEQ ID NO: 7073 - DNA, 33 bp, homo sapien
gcaatggtcaagggaamtgatcactcttccaat

SEQ ID NO: 7074 - DNA, 33 bp, homo sapien
attttctgttacaattrttaattcacaaaaggg

SEQ ID NO: 7075 - DNA, 33 bp, homo sapien
tttgaactttggctgcmtgttggtgtctcttgg

SEQ ID NO: 7076 - DNA, 33 bp, homo sapien
ttcaaaatgattgttayagccaatgaacacaca

SEQ ID NO: 7077 - DNA, 33 bp, homo sapien
atagagagcctgtatamaatggctgttcagtat

SEQ ID NO: 7078 - DNA, 33 bp, homo sapien
caaaatctttgcatcarattaacataatgcagg

SEQ ID NO: 7079 - DNA, 33 bp, homo sapien
tgactcagagctggaayggtgtactaagttaac

SEQ ID NO: 7080 - DNA, 33 bp, homo sapien
tgcacatatctctctgyggctaaagtagaaaca

SEQ ID NO: 7081 - DNA, 33 bp, homo sapien
gaaaatgagatgttcaytggaggatttgaaaag

SEQ ID NO: 7082 - DNA, 33 bp, homo sapien
aatataactagccatcytgtattttatccagca

SEQ ID NO: 7083 - DNA, 33 bp, homo sapien
gcaatgtgaaggacagyatcacaggttataaat

SEQ ID NO: 7084 - DNA, 33 bp, homo sapien
tgaacctataaaactcytagatcataacataga

SEQ ID NO: 7085 - DNA, 33 bp, homo sapien
tgtggtgactcttctawactaaattaacaagga

SEQ ID NO: 7086 - DNA, 33 bp, homo sapien
ttttggcaaagcacctrtttgaatcttttgcct

SEQ ID NO: 7087 - DNA, 33 bp, homo sapien
tcactcttgagaagacrcagcaggggatgcctc

SEQ ID NO: 7088 - DNA, 33 bp, homo sapien
ttagagatttcttttgwcagcttacagaagcca

SEQ ID NO: 7089 - DNA, 33 bp, homo sapien
tgagctatcattgtacractgcactccaacttg

SEQ ID NO: 7090 - DNA, 33 bp, homo sapien
gtggatgctaagtcagwgtttcagctgtaagac

SEQ ID NO: 7091 - DNA, 33 bp, homo sapien
cttgcatatgtttatcmaaatactcccataaat

SEQ ID NO: 7092 - DNA, 33 bp, homo sapien
ttgctctgattgggaaygttgggtactaaagtg

SEQ ID NO: 7093 - DNA, 33 bp, homo sapien
agcatcctgagtaaccyaccgtgtaccactttg

SEQ ID NO: 7094 - DNA, 33 bp, homo sapien
agggccctaagatccayggccgctttagtgaaa

SEQ ID NO: 7095 - DNA, 33 bp, homo sapien
ataaaaaacagaaaggygttgcttacatttctg

SEQ ID NO: 7096 - DNA, 33 bp, homo sapien
tctcttgtcaaatccarttatctgcttacaaga

SEQ ID NO: 7097 - DNA, 33 bp, homo sapien
tatattggtgggatttwaatcaaaccagtagga

SEQ ID NO: 7098 - DNA, 33 bp, homo sapien
gtctagaactttcattsagtgatatgtattgat

SEQ ID NO: 7099 - DNA, 33 bp, homo sapien
gaggggctgtgactttygctgattcaagttaga

SEQ ID NO: 7100 - DNA, 33 bp, homo sapien
aggaagctgggagtgcygcgaatcagtgtaggg

SEQ ID NO: 7101 - DNA, 33 bp, homo sapien
ctcaagggactgtagascactgcatacatctgt

SEQ ID NO: 7102 - DNA, 33 bp, homo sapien
gaaatatcaccacctamgaaaggcatgtatttt

SEQ ID NO: 7103 - DNA, 33 bp, homo sapien
ttatggccattgcagtsttttccttggcagtcc

SEQ ID NO: 7104 - DNA, 33 bp, homo sapien
tcccattcatgatttcmacaatacttatacaac

SEQ ID NO: 7105 - DNA, 33 bp, homo sapien
ggaaatttgatggaagwgaattgtcccccactc

SEQ ID NO: 7106 - DNA, 33 bp, homo sapien
catccagactgcttccrttctgaggcttggcca

SEQ ID NO: 7107 - DNA, 33 bp, homo sapien
cagaagagagaaagcartgtgacaacctcagca

SEQ ID NO: 7108 - DNA, 33 bp, homo sapien
tatgtataatttcaaaytgtagcattaatagga

SEQ ID NO: 7109 - DNA, 33 bp, homo sapien
taaagtatcaacacggrtaagcaaagaaatgct

SEQ ID NO: 7110 - DNA, 33 bp, homo sapien
atggattttgtaggtcragtttggaccgggaac

SEQ ID NO: 7111 - DNA, 33 bp, homo sapien
gaaagacaaggtcaaawgttgattataaggatc

SEQ ID NO: 7112 - DNA, 33 bp, homo sapien
gaaaataacacctcctytttgtaatgctttcac

SEQ ID NO: 7113 - DNA, 33 bp, homo sapien
atcctattttcttgccraactccattgaattcc

SEQ ID NO: 7114 - DNA, 33 bp, homo sapien
cttccacctccaacttrtatcaaccccatttga

SEQ ID NO: 7115 - DNA, 33 bp, homo sapien
ggttctggaagggaccygcagcttcaattctgg

SEQ ID NO: 7116 - DNA, 33 bp, homo sapien
agttttactaaatttgwttgttcctggactcaa

SEQ ID NO: 7117 - DNA, 33 bp, homo sapien
gaaaactcacacaaaaytactgcttcatcaact

SEQ ID NO: 7118 - DNA, 33 bp, homo sapien
ggaaagtaagtgaacasaataatagccaaatat

SEQ ID NO: 7119 - DNA, 33 bp, homo sapien
agccggcagaatagtgmgcgaaaataaatgtct

SEQ ID NO: 7120 - DNA, 33 bp, homo sapien
tttcctgcctctatttyttgtttattttctact

SEQ ID NO: 7121 - DNA, 33 bp, homo sapien
gaatttagcaaacccamgtgatcatttagtgtc

SEQ ID NO: 7122 - DNA, 33 bp, homo sapien
aaaacaaacacaggcartaaaaggacaaaggag

SEQ ID NO: 7123 - DNA, 33 bp, homo sapien
aaaaattacaccagtcrttcaaaaatacatgac

SEQ ID NO: 7124 - DNA, 33 bp, homo sapien
tcgtactaaatagcttrcatttcagagccagaa

SEQ ID NO: 7125 - DNA, 33 bp, homo sapien
tgttccagttgcctccrtaagttaagattttaa

SEQ ID NO: 7126 - DNA, 33 bp, homo sapien
gactttattagtgatcrgcacttatgagtgggg

SEQ ID NO: 7127 - DNA, 33 bp, homo sapien
tttctcaagttttgttrtcaatattatacaaac

SEQ ID NO: 7128 - DNA, 33 bp, homo sapien
agcctcaatttttttckttttaatccatgaaat

SEQ ID NO: 7129 - DNA, 33 bp, homo sapien
ttgtattctactcagamtcttaccctattatgt

SEQ ID NO: 7130 - DNA, 33 bp, homo sapien
taatttaaacatcatcratataatttgctaatt

SEQ ID NO: 7131 - DNA, 33 bp, homo sapien
tttcgtaggtatcaacrtattttatcttgcact

SEQ ID NO: 7132 - DNA, 33 bp, homo sapien
gattgaaatcttcaaartgacaaggccatgtgg

SEQ ID NO: 7133 - DNA, 33 bp, homo sapien
ctataactgagaaccayaaactgagtggctcaa

SEQ ID NO: 7134 - DNA, 33 bp, homo sapien
ttttgcatcatgttatrtactgatcacactaga

SEQ ID NO: 7135 - DNA, 33 bp, homo sapien
ccatttaacatcccttkctttcagttgtcctat

SEQ ID NO: 7136 - DNA, 33 bp, homo sapien
aaaaggcatgatatatytgtctactcctcagtg

SEQ ID NO: 7137 - DNA, 33 bp, homo sapien
tactgagcttagaatgyagatcactccaatcat

SEQ ID NO: 7138 - DNA, 33 bp, homo sapien
acctgtctggtgagctwgtttgtataaagtatc

SEQ ID NO: 7139 - DNA, 33 bp, homo sapien
tcccatttctctatccrtgtaccttaagcatag

SEQ ID NO: 7140 - DNA, 33 bp, homo sapien
atcttgctaagcaaaarcaactgtccctaagtg

SEQ ID NO: 7141 - DNA, 33 bp, homo sapien
gcaagcatgatacaacwtatgaacttgtaaaga

SEQ ID NO: 7142 - DNA, 33 bp, homo sapien
gagaaaatgctctaatytgaaagaaaaagtctg

SEQ ID NO: 7143 - DNA, 33 bp, homo sapien
catcaaaactggatatkctttctacattgtatc

SEQ ID NO: 7144 - DNA, 33 bp, homo sapien
aaccattgtattgattractagtatggaaacag

SEQ ID NO: 7145 - DNA, 33 bp, homo sapien
gcaaccaaattcaacasaagttttagagaggac

SEQ ID NO: 7146 - DNA, 33 bp, homo sapien
aaatttgaaagtggaawaggataggctgagatt

SEQ ID NO: 7147 - DNA, 33 bp, homo sapien
taagcctttggttaagytcctgtgttccaaaaa

SEQ ID NO: 7148 - DNA, 33 bp, homo sapien
cactttccaaaggcagktggttctaaagaagga

SEQ ID NO: 7149 - DNA, 33 bp, homo sapien
acaaaacacactagcakgtatatttggcatctg

SEQ ID NO: 7150 - DNA, 33 bp, homo sapien
aaaaacttaactttcawctagtatccagtatgt

SEQ ID NO: 7151 - DNA, 33 bp, homo sapien
tataaggtgattgggaygagcttttcaacctac

SEQ ID NO: 7152 - DNA, 33 bp, homo sapien
cacactcattcattacstgccattcaatagtcc

SEQ ID NO: 7153 - DNA, 33 bp, homo sapien
ttggctgctcaccactygaaaaacaaactcaag

SEQ ID NO: 7154 - DNA, 33 bp, homo sapien
gaattttgcctgggaaraagtcttggaagcaca

SEQ ID NO: 7155 - DNA, 33 bp, homo sapien
ccctggaaatgcccttytgcatatagccatctc

SEQ ID NO: 7156 - DNA, 33 bp, homo sapien
cctttactttcactggrcttattttgctatagt

SEQ ID NO: 7157 - DNA, 33 bp, homo sapien
acctagtggttatttargtcacccgtgaaattc

SEQ ID NO: 7158 - DNA, 33 bp, homo sapien
tcctttcatactttcayagaactgtaactataa

SEQ ID NO: 7159 - DNA, 33 bp, homo sapien
ggggaaagtggatggayagaaggatgctgcctc

SEQ ID NO: 7160 - DNA, 33 bp, homo sapien
tccaccagccaatcctyagttaatagacatgaa

SEQ ID NO: 7161 - DNA, 33 bp, homo sapien
ttctccctatcagcagwgtcattatacaattgc

SEQ ID NO: 7162 - DNA, 33 bp, homo sapien
gtgagaaagcccacctraaatgatgatcacaga

SEQ ID NO: 7163 - DNA, 33 bp, homo sapien
atgtcagagatcttgtrtatttggacaatgggg

SEQ ID NO: 7164 - DNA, 33 bp, homo sapien
tctgtgtatatgtctaygcattcttgtaaagcc

SEQ ID NO: 7165 - DNA, 33 bp, homo sapien
tactagatggtcttgartatacttcaaattcag

SEQ ID NO: 7166 - DNA, 33 bp, homo sapien
cactatccagtttagayagagtctgcttttctc

SEQ ID NO: 7167 - DNA, 33 bp, homo sapien
gggaatccatctctatygcatggcagccttacc

SEQ ID NO: 7168 - DNA, 33 bp, homo sapien
ccatggctttctgatarcagtgataagaaaatt

SEQ ID NO: 7169 - DNA, 33 bp, homo sapien
aactttggaagacaatytgacactttcttatta

SEQ ID NO: 7170 - DNA, 33 bp, homo sapien
atggtcattatttgacygtacatgtgtgggttt

SEQ ID NO: 7171 - DNA, 33 bp, homo sapien
atgtgggaagacccatsgcatcatcattcaagc

SEQ ID NO: 7172 - DNA, 33 bp, homo sapien
ctggaaatgcttcttaytgatcatgtgaccact

SEQ ID NO: 7173 - DNA, 33 bp, homo sapien
aatagctaacctacttkaaccagctggattgtg

SEQ ID NO: 7174 - DNA, 33 bp, homo sapien
aacctcttgaaactttstatttagtcgttagtt

SEQ ID NO: 7175 - DNA, 33 bp, homo sapien
catgaatctatttactycagaagcagtttcaag

SEQ ID NO: 7176 - DNA, 33 bp, homo sapien
ggtgcatgccactaaawctggccaattaaaatt

SEQ ID NO: 7177 - DNA, 33 bp, homo sapien
tgattatgctctgatcygaaattttaataagaa

SEQ ID NO: 7178 - DNA, 33 bp, homo sapien
atgaagaaagctcttgmattcgtttcctagggc

SEQ ID NO: 7179 - DNA, 33 bp, homo sapien
ccagcctttatgtgcayggtagcagtgtgtaat

SEQ ID NO: 7180 - DNA, 33 bp, homo sapien
tgacccattgatagatygaagcctatagtgtct

SEQ ID NO: 7181 - DNA, 33 bp, homo sapien
gcagagctgtgtgtttyctggaaatgccaggga

SEQ ID NO: 7182 - DNA, 33 bp, homo sapien
tgctgttgtttttgatrttaaaagcacaaatgc

SEQ ID NO: 7183 - DNA, 33 bp, homo sapien
atggcaaaccctatgawgagtcttgagaatttc

SEQ ID NO: 7184 - DNA, 33 bp, homo sapien
ttgacttcaggattcayagttcagctaattggg

SEQ ID NO: 7185 - DNA, 33 bp, homo sapien
gatgtgctgaacagccrcagaaataactaaagt

SEQ ID NO: 7186 - DNA, 33 bp, homo sapien
gctatgccattgttttrcttgttgttattgttt

SEQ ID NO: 7187 - DNA, 33 bp, homo sapien
ttcacaaactagagcamtttgagataaacacta

SEQ ID NO: 7188 - DNA, 33 bp, homo sapien
tacttctccttgtctcrctgatcttagataagc

SEQ ID NO: 7189 - DNA, 33 bp, homo sapien
acatatggtctactggyggtatcctttcctgtt

SEQ ID NO: 7190 - DNA, 33 bp, homo sapien
tcattggtcaatatgcrtagcaagtcaacattc

SEQ ID NO: 7191 - DNA, 33 bp, homo sapien
agatggtttctcaggcytaatgatttactgtca

SEQ ID NO: 7192 - DNA, 33 bp, homo sapien
atatttcaaatattgamtaacacatgacaactg

SEQ ID NO: 7193 - DNA, 33 bp, homo sapien
tacttctggtttttatwcaagtcttctagaaca

SEQ ID NO: 7194 - DNA, 33 bp, homo sapien
ataccacgaacaggtgwtaggtcctttctcttt

SEQ ID NO: 7195 - DNA, 33 bp, homo sapien
gtgtgctgatctgatasagaaaactttttaaag

SEQ ID NO: 7196 - DNA, 33 bp, homo sapien
gagaacacatgtgtctratcttagctatctgaa

SEQ ID NO: 7197 - DNA, 33 bp, homo sapien
gagctcaagttcagtgwcaaaacaacaagcagc

SEQ ID NO: 7198 - DNA, 33 bp, homo sapien
atagcataggcagtccrtcattgaccaaaacat

SEQ ID NO: 7199 - DNA, 33 bp, homo sapien
aagactgtgttgtgcaytagatagatatgctga

SEQ ID NO: 7200 - DNA, 33 bp, homo sapien
agcacattgcacatgcrttaaaaaaaagaatga

SEQ ID NO: 7201 - DNA, 33 bp, homo sapien
tgttataagcttgttcwgaattattattaaaag

SEQ ID NO: 7202 - DNA, 33 bp, homo sapien
attaggctcacatacaytattttaatttgactc

SEQ ID NO: 7203 - DNA, 33 bp, homo sapien
ctatctgtccctatgcratgagaaagcaggaag

SEQ ID NO: 7204 - DNA, 33 bp, homo sapien
gtggataaatttgcttygcgtttggagagtttt

SEQ ID NO: 7205 - DNA, 33 bp, homo sapien
tccaggctatgattgayaattaccatgtaagag

SEQ ID NO: 7206 - DNA, 33 bp, homo sapien
gtaaattctgcctgacmaaggactcatctttca

SEQ ID NO: 7207 - DNA, 33 bp, homo sapien
aataatgatgtatggcygtgcaatgtgtttgca

SEQ ID NO: 7208 - DNA, 33 bp, homo sapien
tcagatgagttcctgayaggttactggccacga

SEQ ID NO: 7209 - DNA, 33 bp, homo sapien
gtctagagaattcactrtgatcttctattctgt

SEQ ID NO: 7210 - DNA, 33 bp, homo sapien
attaaaatgagttgggwagaagttctctcctat

SEQ ID NO: 7211 - DNA, 33 bp, homo sapien
catgtctagatgaataytcaccctgtatgtgta

SEQ ID NO: 7212 - DNA, 33 bp, homo sapien
atcttatgttctgttcyactgcggctaagctga

SEQ ID NO: 7213 - DNA, 33 bp, homo sapien
tgtctggtttctgtagragctgggctgatgcaa

SEQ ID NO: 7214 - DNA, 33 bp, homo sapien
tgcctaaaattgagacygagaggaagtagataa

SEQ ID NO: 7215 - DNA, 33 bp, homo sapien
gctttggtgtcctgttktaactttagtgaaaat

SEQ ID NO: 7216 - DNA, 33 bp, homo sapien
aagagattgttttgatscagaatctctaaccat

SEQ ID NO: 7217 - DNA, 33 bp, homo sapien
gggctatcaaagatcayaaacagtgcaaattga

SEQ ID NO: 7218 - DNA, 33 bp, homo sapien
ttaattttcacctttartcaacagcatacattg

SEQ ID NO: 7219 - DNA, 33 bp, homo sapien
ataataacttccagggyttgcattttttagtta

SEQ ID NO: 7220 - DNA, 33 bp, homo sapien
cacagagaaaccacaamttactggagcagaaac

SEQ ID NO: 7221 - DNA, 33 bp, homo sapien
gctggaccttttctgawtgataaaaaagtgaca

SEQ ID NO: 7222 - DNA, 33 bp, homo sapien
tccatctttgccattgktttgtacaagtgaaag

SEQ ID NO: 7223 - DNA, 33 bp, homo sapien
ctttttctgattgtgawttttgagacctggtta

SEQ ID NO: 7224 - DNA, 33 bp, homo sapien
caaatacaatcagcctytctctttttatttcta

SEQ ID NO: 7225 - DNA, 33 bp, homo sapien
actgttttctgtagcayaatgcatcttcactgt

SEQ ID NO: 7226 - DNA, 33 bp, homo sapien
tacatctatctattcgsgaacaaaaggaagttg

SEQ ID NO: 7227 - DNA, 33 bp, homo sapien
atgtcacggaagagaaraattcaggaatcaaat

SEQ ID NO: 7228 - DNA, 33 bp, homo sapien
gaatctcagaattttgsaagtgcttcaggccgg

SEQ ID NO: 7229 - DNA, 33 bp, homo sapien
catttcctttcacctgsgcagtcacaccctagc

SEQ ID NO: 7230 - DNA, 33 bp, homo sapien
tgtgtcaaagtagaatkagagatggcattgcac

SEQ ID NO: 7231 - DNA, 33 bp, homo sapien
tttcagtaatggtaaartagctcctttgcacta

SEQ ID NO: 7232 - DNA, 33 bp, homo sapien
gagaagagaagagggtyggtttctcatatttga

SEQ ID NO: 7233 - DNA, 33 bp, homo sapien
ggtatacaacatgatgwtatggaacacacgtag

SEQ ID NO: 7234 - DNA, 33 bp, homo sapien
tttactgtgcttataaygattgccagtttcaga

SEQ ID NO: 7235 - DNA, 33 bp, homo sapien
aagaatcattttatccrgtgttaaggcttacta

SEQ ID NO: 7236 - DNA, 33 bp, homo sapien
agaaaaaagagttactwcacaatggggaaacct

SEQ ID NO: 7237 - DNA, 33 bp, homo sapien
cacactttactaacaascatattaatagggatg

SEQ ID NO: 7238 - DNA, 33 bp, homo sapien
ggtaacgcagggatgcrgcatccaataccagtg

SEQ ID NO: 7239 - DNA, 33 bp, homo sapien
tttagccttcgctattktttttaacatgtcctc

SEQ ID NO: 7240 - DNA, 33 bp, homo sapien
aagcatagaatgagtgrttaaaaccaggaaacc

SEQ ID NO: 7241 - DNA, 33 bp, homo sapien
gagttagaaagagcaaytgaatatgttggtgcc

SEQ ID NO: 7242 - DNA, 33 bp, homo sapien
tggcgtgatttggcaayagaaatatgcaaaata

SEQ ID NO: 7243 - DNA, 33 bp, homo sapien
tcttggtggacattaayggaatcacacactgta

SEQ ID NO: 7244 - DNA, 33 bp, homo sapien
taataactcatgaacamttttaagaattacatc

SEQ ID NO: 7245 - DNA, 33 bp, homo sapien
aagtatagatgtaaagrtgtatgtgtatataca

SEQ ID NO: 7246 - DNA, 33 bp, homo sapien
atgcgaccactgaataytactgagtttcttctg

SEQ ID NO: 7247 - DNA, 33 bp, homo sapien
tactctcggtgtgaaaktagagtaataatgatc

SEQ ID NO: 7248 - DNA, 33 bp, homo sapien
gatggaaatataggaaracaactaaggtctact

SEQ ID NO: 7249 - DNA, 33 bp, homo sapien
acatttgatttttttamcgtaagatttcgtatt

SEQ ID NO: 7250 - DNA, 33 bp, homo sapien
ccctgaggatttaaackgtacagacagggatct

SEQ ID NO: 7251 - DNA, 33 bp, homo sapien
gccctaggctaatctawgtcagccatctgagct

SEQ ID NO: 7252 - DNA, 33 bp, homo sapien
tttaataacttggcacstatttatatattatgt

SEQ ID NO: 7253 - DNA, 33 bp, homo sapien
ttgtatctctgcttaartaaccaagatgtgttg

SEQ ID NO: 7254 - DNA, 33 bp, homo sapien
atgatcgtctcatgccrttctcctaactcatat

SEQ ID NO: 7255 - DNA, 33 bp, homo sapien
ctcctcttctatatctwaagtacaaaagcttca

SEQ ID NO: 7256 - DNA, 33 bp, homo sapien
tgtttatagttttaatktttaatgagcttagcc

SEQ ID NO: 7257 - DNA, 33 bp, homo sapien
cattttccatgaacackatatttttgtaacctc

SEQ ID NO: 7258 - DNA, 33 bp, homo sapien
tcttcttgttgttgttycaaagttacaattaaa

SEQ ID NO: 7259 - DNA, 33 bp, homo sapien
taaatgatgtgctaatrcatggtatcattctaa

SEQ ID NO: 7260 - DNA, 33 bp, homo sapien
tccctcttttgagttgytggaacataaatcatt

SEQ ID NO: 7261 - DNA, 33 bp, homo sapien
gtgcagcagtaaaatgwtcaaacaattttggaa

SEQ ID NO: 7262 - DNA, 33 bp, homo sapien
gtgaggctaaaataaayagtcttcattcacaaa

SEQ ID NO: 7263 - DNA, 33 bp, homo sapien
aacaagctaagttgcayttgaattttgaaatac

SEQ ID NO: 7264 - DNA, 33 bp, homo sapien
tatcagagaattgggcrtgagtttagagtgctg

SEQ ID NO: 7265 - DNA, 33 bp, homo sapien
gtccaagagaacttaayggttttccagaccttt

SEQ ID NO: 7266 - DNA, 33 bp, homo sapien
gtcactggacaatttasataagggtatgtcttt

SEQ ID NO: 7267 - DNA, 33 bp, homo sapien
taactctgaaagacctyatatttctgcagggcc

SEQ ID NO: 7268 - DNA, 33 bp, homo sapien
tttttgaatagcagggraccatagcctagccaa

SEQ ID NO: 7269 - DNA, 33 bp, homo sapien
aagcaaaacaaaataawacctccaagaaacaaa

SEQ ID NO: 7270 - DNA, 33 bp, homo sapien
ttttccctgaagaaacrtaagtagcaggccatg

SEQ ID NO: 7271 - DNA, 33 bp, homo sapien
ttgatttcaattctttygggtaaatactcagaa

SEQ ID NO: 7272 - DNA, 33 bp, homo sapien
aacgccaaagtgtttcrggaaaaatcaatagca

SEQ ID NO: 7273 - DNA, 33 bp, homo sapien
gaaattagctttcttayctgaaaatctgaattt

SEQ ID NO: 7274 - DNA, 33 bp, homo sapien
atgatacccaaatattsatttcatggacataag

SEQ ID NO: 7275 - DNA, 33 bp, homo sapien
catattgtatgtgaaayttttgaaacagtaggt

SEQ ID NO: 7276 - DNA, 33 bp, homo sapien
aagcctagacttcagayttactaagcaaaaact

SEQ ID NO: 7277 - DNA, 33 bp, homo sapien
gatgcagcatagaagcrtagaacgtttaggaaa

SEQ ID NO: 7278 - DNA, 33 bp, homo sapien
cctacctttcaagaaamtgcacagggtcacgac

SEQ ID NO: 7279 - DNA, 33 bp, homo sapien
aacttcttccaaatgcrttagcctcctacctgc

SEQ ID NO: 7280 - DNA, 33 bp, homo sapien
atgagtatttgactgcytaacttttcagggcac

SEQ ID NO: 7281 - DNA, 33 bp, homo sapien
aatactgtccaagattmaacctttctacgcatc

SEQ ID NO: 7282 - DNA, 33 bp, homo sapien
ctcgtggttttaaacaygttatgtgtgctagca

SEQ ID NO: 7283 - DNA, 33 bp, homo sapien
aatgtggaactgtgtcytgctatgcctgactgt

SEQ ID NO: 7284 - DNA, 33 bp, homo sapien
tgcttttccttaatttyctcactgccataatta

SEQ ID NO: 7285 - DNA, 33 bp, homo sapien
gtgtgattgttttataygactttgagttttata

SEQ ID NO: 7286 - DNA, 33 bp, homo sapien
tcatctagattcgagtyctttcctgatacttaa

SEQ ID NO: 7287 - DNA, 33 bp, homo sapien
actgcactttccacagmtttttgctcatgctgc

SEQ ID NO: 7288 - DNA, 33 bp, homo sapien
aatgtgagcaaaggatsgagtggaaggagctga

SEQ ID NO: 7289 - DNA, 33 bp, homo sapien
aaaatgaccagttcttyctaagtctttcatttt

SEQ ID NO: 7290 - DNA, 33 bp, homo sapien
tttggatatgacaaatrtttaatgctgatacta

SEQ ID NO: 7291 - DNA, 33 bp, homo sapien
tttaaaataacatcgcrggaaactactttgaca

SEQ ID NO: 7292 - DNA, 33 bp, homo sapien
ggtggggacatgatgasgacttagctctcagag

SEQ ID NO: 7293 - DNA, 33 bp, homo sapien
tcttgtcatattccaaytttgtgtttctactcc

SEQ ID NO: 7294 - DNA, 33 bp, homo sapien
ttcaaaaggtgaacctygcatattcttacttta

SEQ ID NO: 7295 - DNA, 33 bp, homo sapien
ataaatcctggactctraaaaaacggaatttga

SEQ ID NO: 7296 - DNA, 33 bp, homo sapien
gtatcttttacagggtsagagtagataattgct

SEQ ID NO: 7297 - DNA, 33 bp, homo sapien
tattgatcaataggttmaatgtgattacaatga

SEQ ID NO: 7298 - DNA, 33 bp, homo sapien
ttttaattagtcatacyttcccataattgttga

SEQ ID NO: 7299 - DNA, 33 bp, homo sapien
tgttaagttattgcacrtgagataaagatgatt

SEQ ID NO: 7300 - DNA, 33 bp, homo sapien
gtgggctgccgacatgkgtagtggcctgctggc

SEQ ID NO: 7301 - DNA, 33 bp, homo sapien
tggccatcacaggtaarttcttacaatgttgga

SEQ ID NO: 7302 - DNA, 33 bp, homo sapien
ggaggtagagagaatgraaattaaaatatagct

SEQ ID NO: 7303 - DNA, 33 bp, homo sapien
ctaccagacagactggraaactcttaattcatg

SEQ ID NO: 7304 - DNA, 33 bp, homo sapien
ctctgcttaggatggtyttgcttgccaagtttt

SEQ ID NO: 7305 - DNA, 33 bp, homo sapien
ggcgatctcttcgcttyctgtaaatagatgttt

SEQ ID NO: 7306 - DNA, 33 bp, homo sapien
agcactactgttaatgratatactgcttgtccc

SEQ ID NO: 7307 - DNA, 33 bp, homo sapien
tttcattcacatggaaycttcaactataaattt

SEQ ID NO: 7308 - DNA, 33 bp, homo sapien
ctagaatgcaaatgagycttttttccttcatcc

SEQ ID NO: 7309 - DNA, 33 bp, homo sapien
gtgaattatctaatggygaataaagagaatgaa

SEQ ID NO: 7310 - DNA, 33 bp, homo sapien
gttcttttataaatccrttcactacccatccat

SEQ ID NO: 7311 - DNA, 33 bp, homo sapien
agatagatgcttatttrtgaccttttaattcat

SEQ ID NO: 7312 - DNA, 33 bp, homo sapien
ctttgtcaggcatttcrcagctttgtgtctcgg

SEQ ID NO: 7313 - DNA, 33 bp, homo sapien
tggggaaaacagttgcrtaaagcagaatgccaa

SEQ ID NO: 7314 - DNA, 33 bp, homo sapien
tcggtttgcaaaataartttggtctcattaaac

SEQ ID NO: 7315 - DNA, 33 bp, homo sapien
acaatatcaatcaaatktcagtaaacaataaag

SEQ ID NO: 7316 - DNA, 33 bp, homo sapien
taccaaggagtgtgctwgctagattgtatgtta

SEQ ID NO: 7317 - DNA, 33 bp, homo sapien
tatttccgtctctgccwtcatgacagaaagcca

SEQ ID NO: 7318 - DNA, 33 bp, homo sapien
attctccatatgcctgracatttgattggatgc

SEQ ID NO: 7319 - DNA, 33 bp, homo sapien
gggattccaggcacatyctaactcaggatatct

SEQ ID NO: 7320 - DNA, 33 bp, homo sapien
cttaaatcctctcttarccatcatgagataact

SEQ ID NO: 7321 - DNA, 33 bp, homo sapien
attatcagatatcgaayttataaactacaatat

SEQ ID NO: 7322 - DNA, 33 bp, homo sapien
ttttcataacttagtcrtatttctcttgcattc

SEQ ID NO: 7323 - DNA, 33 bp, homo sapien
ctgttgatatccagttytcaaatgaccatcagt

SEQ ID NO: 7324 - DNA, 33 bp, homo sapien
cagacaccacttttaartaacagcaatattaat

SEQ ID NO: 7325 - DNA, 33 bp, homo sapien
gggccactggccatccrgaactaatgcccaaga

SEQ ID NO: 7326 - DNA, 33 bp, homo sapien
attatactacagggaarcaaaccaaaacagcat

SEQ ID NO: 7327 - DNA, 33 bp, homo sapien
tctactgtctactgcamgaaagagaaaataggt

SEQ ID NO: 7328 - DNA, 33 bp, homo sapien
aggtccgtaagtaaccytaaagaaaatccacca

SEQ ID NO: 7329 - DNA, 33 bp, homo sapien
ccttggcccccagctgmttttacagatttttcc

SEQ ID NO: 7330 - DNA, 33 bp, homo sapien
ttgcattctgagagcarcttttgacagaagcat

SEQ ID NO: 7331 - DNA, 33 bp, homo sapien
cattataagaaagaccrtatgcaagctaaaact

SEQ ID NO: 7332 - DNA, 33 bp, homo sapien
gcattctgagactccgyataccagacgggtggc

SEQ ID NO: 7333 - DNA, 33 bp, homo sapien
gcagtgccaagttgagrcaatggcttaacatgg

SEQ ID NO: 7334 - DNA, 33 bp, homo sapien
actagaatagcagagawaatgaagaaatttggg

SEQ ID NO: 7335 - DNA, 33 bp, homo sapien
ctggttatgttgtttaytgatatcctgcctccg

SEQ ID NO: 7336 - DNA, 33 bp, homo sapien
atttgtttgaatgtggrtcaaaataaggtccat

SEQ ID NO: 7337 - DNA, 33 bp, homo sapien
gagggtttcacagatgrgaaaaattagatgaat

SEQ ID NO: 7338 - DNA, 33 bp, homo sapien
atccaggcacatagcasgaagcatcacccttaa

SEQ ID NO: 7339 - DNA, 33 bp, homo sapien
caaccactgattgtccrgaattcagaccacaaa

SEQ ID NO: 7340 - DNA, 33 bp, homo sapien
cttttagattgtatcayctctttacactccaac

SEQ ID NO: 7341 - DNA, 33 bp, homo sapien
acatagaaaatgtgcaktaaaaatatggtatta

SEQ ID NO: 7342 - DNA, 33 bp, homo sapien
aatagaaagagcatgtyaggaaaatgaaaaact

SEQ ID NO: 7343 - DNA, 33 bp, homo sapien
cgtcaatttggctgttkttctccagaaccctca

SEQ ID NO: 7344 - DNA, 33 bp, homo sapien
ctatacagtgtctacayatttgatgataatgcc

SEQ ID NO: 7345 - DNA, 33 bp, homo sapien
tcttgttaggtttgctytattctttattattct

SEQ ID NO: 7346 - DNA, 33 bp, homo sapien
atacataaaatccatgrcaacacctgggattga

SEQ ID NO: 7347 - DNA, 33 bp, homo sapien
cctatacattctttcarttctgtccaccttact

SEQ ID NO: 7348 - DNA, 33 bp, homo sapien
cagtaattaccattacygtaactgctgtcagct

SEQ ID NO: 7349 - DNA, 33 bp, homo sapien
atggttactccaactcrccttgtccacagagag

SEQ ID NO: 7350 - DNA, 33 bp, homo sapien
tctttggtgaggtatgygttaaggtctttggcc

SEQ ID NO: 7351 - DNA, 33 bp, homo sapien
cattattttcatctacraatggaacaatctgta

SEQ ID NO: 7352 - DNA, 33 bp, homo sapien
agtcatcacttcacacygggatggctggcatgg

SEQ ID NO: 7353 - DNA, 33 bp, homo sapien
tagaacaatgtggagawttttttaggacaaagt

SEQ ID NO: 7354 - DNA, 33 bp, homo sapien
tcgctctccttttactyggtgactcttcctctg

SEQ ID NO: 7355 - DNA, 33 bp, homo sapien
tttaactacacctacawcttatagaaactcatc

SEQ ID NO: 7356 - DNA, 33 bp, homo sapien
ctctttgagtgaagacrtaagatctattcttta

SEQ ID NO: 7357 - DNA, 33 bp, homo sapien
atagttgcataatttgmtaactaattctacttc

SEQ ID NO: 7358 - DNA, 33 bp, homo sapien
gcccaaatctaatccartgcaagacactaactc

SEQ ID NO: 7359 - DNA, 33 bp, homo sapien
atgtcttgcagatatgrttatagagaaaagagc

SEQ ID NO: 7360 - DNA, 33 bp, homo sapien
tggaactgccagcatcrtgagattatagtttgc

SEQ ID NO: 7361 - DNA, 33 bp, homo sapien
caaaatgagattgattrtaaacctatgtattag

SEQ ID NO: 7362 - DNA, 33 bp, homo sapien
aatttagagctttatcrcttgatgaggtaattg

SEQ ID NO: 7363 - DNA, 33 bp, homo sapien
cttacagcaccatgcawtagaaaagatttgaga

SEQ ID NO: 7364 - DNA, 33 bp, homo sapien
tggcgtgaaccctggcrttttcatgatttggtt

SEQ ID NO: 7365 - DNA, 33 bp, homo sapien
ttagaggagaggaaacrgaattaattagttaga

SEQ ID NO: 7366 - DNA, 33 bp, homo sapien
cagatatatttcaacastaaaatttagcgataa

SEQ ID NO: 7367 - DNA, 33 bp, homo sapien
agggaaaagcactaggmaaagtccaagtttgtg

SEQ ID NO: 7368 - DNA, 33 bp, homo sapien
ctatgaaagtctaataktgcaattctttccctt

SEQ ID NO: 7369 - DNA, 33 bp, homo sapien
ggatacataaacttacraaaagatgataaattc

SEQ ID NO: 7370 - DNA, 33 bp, homo sapien
gcccattgtacatccamctcgttgttttccatg

SEQ ID NO: 7371 - DNA, 33 bp, homo sapien
tgtagggatctttagcyttgaaaactgagtaga

SEQ ID NO: 7372 - DNA, 33 bp, homo sapien
aattttgtacctttcawtttcaacaaatatctt

SEQ ID NO: 7373 - DNA, 33 bp, homo sapien
atgtaaaaattgttcarctatacagagagttcc

SEQ ID NO: 7374 - DNA, 33 bp, homo sapien
agaagccttttaaaaakcaggtgccccttctgc

SEQ ID NO: 7375 - DNA, 33 bp, homo sapien
gattcataaactattayacatttgccaaggtat

SEQ ID NO: 7376 - DNA, 33 bp, homo sapien
tttccagatcaaaacasagtgtgcctttgtata

SEQ ID NO: 7377 - DNA, 33 bp, homo sapien
atttgtagccagtgttkcgtgtcttagcgttct

SEQ ID NO: 7378 - DNA, 33 bp, homo sapien
tgataaagatcagtaaygtaggataaacctcca

SEQ ID NO: 7379 - DNA, 33 bp, homo sapien
tcaccagagtggaccasaaaaataaaaaaccac

SEQ ID NO: 7380 - DNA, 33 bp, homo sapien
ggctgtcattcctacargccagtataataacac

SEQ ID NO: 7381 - DNA, 33 bp, homo sapien
gctcactcagtgatacracccttttataagatc

SEQ ID NO: 7382 - DNA, 33 bp, homo sapien
gcaacaccaggctttayctgtatcactcgtatt

SEQ ID NO: 7383 - DNA, 33 bp, homo sapien
ctgaaggataccatatracttggcactcattaa

SEQ ID NO: 7384 - DNA, 33 bp, homo sapien
aattccactttgtcacwtgccagatactatgtc

SEQ ID NO: 7385 - DNA, 33 bp, homo sapien
ctggaaaaaacatcacractctaaattataaac

SEQ ID NO: 7386 - DNA, 33 bp, homo sapien
ctacaagtgttaaaatrtacctacaaatgcaaa

SEQ ID NO: 7387 - DNA, 33 bp, homo sapien
tgatcatacacttgctkttgtctctgtgcattt

SEQ ID NO: 7388 - DNA, 33 bp, homo sapien
tttggccttattgatasattttgactttaggca

SEQ ID NO: 7389 - DNA, 33 bp, homo sapien
tggctcaaagtgaacasccttttttgccaagga

SEQ ID NO: 7390 - DNA, 33 bp, homo sapien
cccttcatctttcaagrcacagcgcaggactta

SEQ ID NO: 7391 - DNA, 33 bp, homo sapien
ctcgaaggttcctgcarttctaacatttgatct

SEQ ID NO: 7392 - DNA, 33 bp, homo sapien
ctcaaggtggtgcgtgsagtacatttttttagc

SEQ ID NO: 7393 - DNA, 33 bp, homo sapien
atgggaaggcagactcrtgattattccaaagat

SEQ ID NO: 7394 - DNA, 33 bp, homo sapien
gtaacatggaggaaatrtctactgggtaaatgt

SEQ ID NO: 7395 - DNA, 33 bp, homo sapien
tccatgcccagagattkgatttaggtgatgtgg

SEQ ID NO: 7396 - DNA, 33 bp, homo sapien
gggaaggctagcattgygtctgacatgtaacag

SEQ ID NO: 7397 - DNA, 33 bp, homo sapien
gcccagccttagctctkgtccctctcgatgctg

SEQ ID NO: 7398 - DNA, 33 bp, homo sapien
agtctgtcagaattccmtgtgggcctgtggtgg

SEQ ID NO: 7399 - DNA, 33 bp, homo sapien
ggaagtcaatctttgcrctcagggttgaaattt

SEQ ID NO: 7400 - DNA, 33 bp, homo sapien
aacacttcaactgtaaycttttaagagacccta

SEQ ID NO: 7401 - DNA, 33 bp, homo sapien
ttaaatttaaggacacrtataggctgaaagtaa

SEQ ID NO: 7402 - DNA, 33 bp, homo sapien
acgtcatgaactcagcrttggaagtttttctag

SEQ ID NO: 7403 - DNA, 33 bp, homo sapien
gttgttgcatttatctrtcaattattatagtgt

SEQ ID NO: 7404 - DNA, 33 bp, homo sapien
tgtgtgtcaggtcagcygaaggatgaaggaagg

SEQ ID NO: 7405 - DNA, 33 bp, homo sapien
ggcttcacactcccacktccattcagcagaatc

SEQ ID NO: 7406 - DNA, 33 bp, homo sapien
tgggttccttataaaaygacaaattcagccccc

SEQ ID NO: 7407 - DNA, 33 bp, homo sapien
gatttaaaagatgtttyctgttgatagtacttc

SEQ ID NO: 7408 - DNA, 33 bp, homo sapien
taaggcaagtcttaatraattcgaaaattgaaa

SEQ ID NO: 7409 - DNA, 33 bp, homo sapien
cttctaggaatttgtcrtttaaagatcctaatt

SEQ ID NO: 7410 - DNA, 33 bp, homo sapien
atattacagagttcacrgtattcatatttagtt

SEQ ID NO: 7411 - DNA, 33 bp, homo sapien
agaattcatgacaccayggactagagtagctca

SEQ ID NO: 7412 - DNA, 33 bp, homo sapien
atgttggattacctatrcaggctgacattttca

SEQ ID NO: 7413 - DNA, 33 bp, homo sapien
ataaattaaaagaatayacagctatacagggac

SEQ ID NO: 7414 - DNA, 33 bp, homo sapien
caagatggcagaatggrtctttaaaaggcaggc

SEQ ID NO: 7415 - DNA, 33 bp, homo sapien
atgctcaatcctgcttytttttctgtgttctct

SEQ ID NO: 7416 - DNA, 33 bp, homo sapien
gaagagagaaaagtgamtaatgactgactaaca

SEQ ID NO: 7417 - DNA, 33 bp, homo sapien
ttaagatttttagacgrtaaagtgctaggagac

SEQ ID NO: 7418 - DNA, 33 bp, homo sapien
actctgatattgctaawcttctggtattgtttc

SEQ ID NO: 7419 - DNA, 33 bp, homo sapien
ttgaacttcttcatatratagtcagatagttgt

SEQ ID NO: 7420 - DNA, 33 bp, homo sapien
cttggagtctgttaatraggaatttttggaggt

SEQ ID NO: 7421 - DNA, 33 bp, homo sapien
tatactgtattttcacygcaattttctaaataa

SEQ ID NO: 7422 - DNA, 33 bp, homo sapien
attgtggattgaccacstaatctcatcataccc

SEQ ID NO: 7423 - DNA, 33 bp, homo sapien
taattccttagcgcagmacagtgtagccttgag

SEQ ID NO: 7424 - DNA, 33 bp, homo sapien
cattatggctaagcatwaagctgttatcagacc

SEQ ID NO: 7425 - DNA, 33 bp, homo sapien
gaaattcttcataaacstgacctggacggtgtg

SEQ ID NO: 7426 - DNA, 33 bp, homo sapien
ttgtcacaaatcaattwaccattaatgtaacag

SEQ ID NO: 7427 - DNA, 33 bp, homo sapien
ggggcaaaacaagggtkaaaactagctactcag

SEQ ID NO: 7428 - DNA, 33 bp, homo sapien
tgggcattgattaccgrtaaaagtttgtttacc

SEQ ID NO: 7429 - DNA, 33 bp, homo sapien
aagtaagattccacttrcattttatatctgaag

SEQ ID NO: 7430 - DNA, 33 bp, homo sapien
ttaacaaaggttctaargtacgaaaagatgtaa

SEQ ID NO: 7431 - DNA, 33 bp, homo sapien
ggagggaaacagacaastgttgcattcctgtcc

SEQ ID NO: 7432 - DNA, 33 bp, homo sapien
cctggattaagtcacaytttccattgtcttttc

SEQ ID NO: 7433 - DNA, 33 bp, homo sapien
catatctttcgggtaartgattcttctctaaag

SEQ ID NO: 7434 - DNA, 33 bp, homo sapien
ttgtgtcgtctataatktcttgcagcagtgttt

SEQ ID NO: 7435 - DNA, 33 bp, homo sapien
gtcaggttctggtcaargtcctattctaaggtc

SEQ ID NO: 7436 - DNA, 33 bp, homo sapien
taggtctgttctttctytattgtttggatattt

SEQ ID NO: 7437 - DNA, 33 bp, homo sapien
ctgtattataatgtgcraccagattaagctatc

SEQ ID NO: 7438 - DNA, 33 bp, homo sapien
aacacattgttttcttkggatagcaaggacaaa

SEQ ID NO: 7439 - DNA, 33 bp, homo sapien
cctcaggcaactgacartcatggcagaaggtga

SEQ ID NO: 7440 - DNA, 33 bp, homo sapien
acagcttaaaggtctcrtccgtattttcatcta

SEQ ID NO: 7441 - DNA, 33 bp, homo sapien
aggtgtagcttaaagamtataaaatcatgtctg

SEQ ID NO: 7442 - DNA, 33 bp, homo sapien
tactgttgtgcaactcktgacttcatcatggct

SEQ ID NO: 7443 - DNA, 33 bp, homo sapien
caccaggtactatgctrtatcttatatgatggt

SEQ ID NO: 7444 - DNA, 33 bp, homo sapien
tatatttgatacttgayttttatattcaatgga

SEQ ID NO: 7445 - DNA, 33 bp, homo sapien
tgttctccatggtctcraggcctctatacatta

SEQ ID NO: 7446 - DNA, 33 bp, homo sapien
ccacctggctatgctayagaagacaagaagctt

SEQ ID NO: 7447 - DNA, 33 bp, homo sapien
atcacttcatgcagtamtttcacccttgggaat

SEQ ID NO: 7448 - DNA, 33 bp, homo sapien
tgatggggaccacttcrggagcaaaggccaaag

SEQ ID NO: 7449 - DNA, 33 bp, homo sapien
aaagcattccattttayaatcagacagttcaga

SEQ ID NO: 7450 - DNA, 33 bp, homo sapien
gagtatagagcaaggcrtggctaaaatacaagc

SEQ ID NO: 7451 - DNA, 33 bp, homo sapien
tcttactttctcccaamtgaacagtgttcctct

SEQ ID NO: 7452 - DNA, 33 bp, homo sapien
tctcaacatttttgtgracttcccaaaatcatt

SEQ ID NO: 7453 - DNA, 33 bp, homo sapien
agtcacacctgatgtcmgcatgtctcagagccc

SEQ ID NO: 7454 - DNA, 33 bp, homo sapien
tgtttcctctaacttgytttgtctctatttttt

SEQ ID NO: 7455 - DNA, 33 bp, homo sapien
gctctggctagaatttmcaataatatgttgaat

SEQ ID NO: 7456 - DNA, 33 bp, homo sapien
acaatactaaacgttgrtgagaatgtggagcaa

SEQ ID NO: 7457 - DNA, 33 bp, homo sapien
gctccaagcaagctctygtattccaggcatatc

SEQ ID NO: 7458 - DNA, 33 bp, homo sapien
agctactccggtggccraggcatgaaaatcact

SEQ ID NO: 7459 - DNA, 33 bp, homo sapien
ctaagcaatccattaawcttctcctggctacta

SEQ ID NO: 7460 - DNA, 33 bp, homo sapien
aatttggaccatattcwtcttcatctttatttc

SEQ ID NO: 7461 - DNA, 33 bp, homo sapien
aatctgaggaaccttcmtaatgctttctgtagt

SEQ ID NO: 7462 - DNA, 33 bp, homo sapien
gatactcagcatcttcktcgtctcctatcactc

SEQ ID NO: 7463 - DNA, 33 bp, homo sapien
acttcttcccaagtccraatcagtttcttaggt

SEQ ID NO: 7464 - DNA, 33 bp, homo sapien
gtttgaaagttgtataygttaatgattgtctgc

SEQ ID NO: 7465 - DNA, 33 bp, homo sapien
tctataaaagttaccamaaatgttatggcttaa

SEQ ID NO: 7466 - DNA, 33 bp, homo sapien
gatgccattttcagacrtttagagctatgttac

SEQ ID NO: 7467 - DNA, 33 bp, homo sapien
ttacgcacattttaatragttgcatattttgac

SEQ ID NO: 7468 - DNA, 33 bp, homo sapien
agtccagttccaagttrgaggtccacattcaaa

SEQ ID NO: 7469 - DNA, 33 bp, homo sapien
aacctcctgaattcttyttcaggcaaatcaggg

SEQ ID NO: 7470 - DNA, 33 bp, homo sapien
tggactgtagcactagwcttgtgaatttgaacc

SEQ ID NO: 7471 - DNA, 33 bp, homo sapien
ccagaagctgcaaaaarcaaggattttcccttt

SEQ ID NO: 7472 - DNA, 33 bp, homo sapien
agtcatattagtgatgrttcaatgcattttttc

SEQ ID NO: 7473 - DNA, 33 bp, homo sapien
ttagctgataagctaayaagaatcaacatttac

SEQ ID NO: 7474 - DNA, 33 bp, homo sapien
ttttctgattttaatcygtcaggtttccatgtt

SEQ ID NO: 7475 - DNA, 33 bp, homo sapien
ggtcccttgcagtgcarcatggagctatatttg

SEQ ID NO: 7476 - DNA, 33 bp, homo sapien
cacattacctcatttgkctataaagttgtacag

SEQ ID NO: 7477 - DNA, 33 bp, homo sapien
gatggcaagtctcaatrgtttgctagatggcaa

SEQ ID NO: 7478 - DNA, 33 bp, homo sapien
aattaggtcaggtcctyaaacttggtcacccat

SEQ ID NO: 7479 - DNA, 33 bp, homo sapien
tccctcaaaacattctrtcttgtaatcccctga

SEQ ID NO: 7480 - DNA, 33 bp, homo sapien
atgcttatttagaaaaytcaactatcacccagc

SEQ ID NO: 7481 - DNA, 33 bp, homo sapien
acccactccctcaacartgacattaattcattc

SEQ ID NO: 7482 - DNA, 33 bp, homo sapien
aggttttcaggattccytggtatttttaaagtt

SEQ ID NO: 7483 - DNA, 33 bp, homo sapien
acacaagcatcaaagtrttaataagaacatttt

SEQ ID NO: 7484 - DNA, 33 bp, homo sapien
caatcagacagcttatyttcagctcagttaagt

SEQ ID NO: 7485 - DNA, 33 bp, homo sapien
gtgtgattctggatacrttttgaaaatagaacc

SEQ ID NO: 7486 - DNA, 33 bp, homo sapien
taaggaaatggagaagraatgagactgagagat

SEQ ID NO: 7487 - DNA, 33 bp, homo sapien
gattcttgttctcgccrcatcagtgtttttctt

SEQ ID NO: 7488 - DNA, 33 bp, homo sapien
tgttttggactttatasaggaaataattccatt

SEQ ID NO: 7489 - DNA, 33 bp, homo sapien
aagttgatgtcacctartgtaaaaaaaagggag

SEQ ID NO: 7490 - DNA, 33 bp, homo sapien
tgtagactcataagccyaggtttgaactggtta

SEQ ID NO: 7491 - DNA, 33 bp, homo sapien
ctgtctgtcatgcacckagttgatggtcttctc

SEQ ID NO: 7492 - DNA, 33 bp, homo sapien
tagctgacaactgtaawtgtctttttacctagt

SEQ ID NO: 7493 - DNA, 33 bp, homo sapien
aacatcatttgtgagaygcacaattcacagagg

SEQ ID NO: 7494 - DNA, 33 bp, homo sapien
acttggttggatttgayttcttcttatgaggtt

SEQ ID NO: 7495 - DNA, 33 bp, homo sapien
tattcacattcatcacrgtaatgacaatgtcct

SEQ ID NO: 7496 - DNA, 33 bp, homo sapien
aaatgaaacaataaagkcttgctaacaaggggc

SEQ ID NO: 7497 - DNA, 33 bp, homo sapien
aaactatacatttagaraagagcaaaccgtaga

SEQ ID NO: 7498 - DNA, 33 bp, homo sapien
agcatggatcaatgagrcaaaaagaaaatcaag

SEQ ID NO: 7499 - DNA, 33 bp, homo sapien
acgagagatatttaccraagggattctttatta

SEQ ID NO: 7500 - DNA, 33 bp, homo sapien
tctagaaatcctgtttwcttcactcaggcaaat

SEQ ID NO: 7501 - DNA, 33 bp, homo sapien
gaagcacctgttagtckttctggcacttaaaat

SEQ ID NO: 7502 - DNA, 33 bp, homo sapien
tgtccaaaacaataaargtagtaacctctatga

SEQ ID NO: 7503 - DNA, 33 bp, homo sapien
cattcatgtattgtcartagcagtgagattggt

SEQ ID NO: 7504 - DNA, 33 bp, homo sapien
tgatacctgcaaaagtmaaaaacaccaggtaac

SEQ ID NO: 7505 - DNA, 33 bp, homo sapien
taatactatgtggcaayaaatggtggaaactca

SEQ ID NO: 7506 - DNA, 33 bp, homo sapien
tgtaatctctgaccccrtagcatccttctgacc

SEQ ID NO: 7507 - DNA, 33 bp, homo sapien
ccatgctaatatacatsgcttggagtttgttag

SEQ ID NO: 7508 - DNA, 33 bp, homo sapien
ctaaaggaatgacctayatagcattaaaacagt

SEQ ID NO: 7509 - DNA, 33 bp, homo sapien
cacttagcctgatgacytacttaatgttcaatc

SEQ ID NO: 7510 - DNA, 33 bp, homo sapien
atttctcaacaaccaawgtttgaacaactagag

SEQ ID NO: 7511 - DNA, 33 bp, homo sapien
attggtatgcccatcarttcaagcatttatcat

SEQ ID NO: 7512 - DNA, 33 bp, homo sapien
atttgaagatgctgccytctttcttatcactcc

SEQ ID NO: 7513 - DNA, 33 bp, homo sapien
tgggataacacaggtcrttaaaggtctgcaggg

SEQ ID NO: 7514 - DNA, 33 bp, homo sapien
agagtcagtgagtcatscaatgccctataactg

SEQ ID NO: 7515 - DNA, 33 bp, homo sapien
attaaaatcacccgtcraatctttactagctac

SEQ ID NO: 7516 - DNA, 33 bp, homo sapien
aagaagtgaattaaacrgagaagactagaaaac

SEQ ID NO: 7517 - DNA, 33 bp, homo sapien
attaagaccagatgtgrgcacagagattcaggg

SEQ ID NO: 7518 - DNA, 33 bp, homo sapien
tttctatctgggttgargtttaatttctgcctg

SEQ ID NO: 7519 - DNA, 33 bp, homo sapien
agcatgtgaatgagaayttccaaattaaccaaa

SEQ ID NO: 7520 - DNA, 33 bp, homo sapien
ggaagggggtcagaaayatttggatggaatgag

SEQ ID NO: 7521 - DNA, 33 bp, homo sapien
ttgtgttgaaatttggycttcaatattagaggt

SEQ ID NO: 7522 - DNA, 33 bp, homo sapien
tggcaccagcaggtccmtttggatctggttgtt

SEQ ID NO: 7523 - DNA, 33 bp, homo sapien
tagttatgtagtggtawttcagtgaggttttaa

SEQ ID NO: 7524 - DNA, 33 bp, homo sapien
tatactccaactgtccrcttcttcaatctcacc

SEQ ID NO: 7525 - DNA, 33 bp, homo sapien
atgactgatggtactcsaaatcaccttatagac

SEQ ID NO: 7526 - DNA, 33 bp, homo sapien
aagagggcatttcaatraaggaaggtctatgtt

SEQ ID NO: 7527 - DNA, 33 bp, homo sapien
aattttgacacattacytacattacttataaaa

SEQ ID NO: 7528 - DNA, 33 bp, homo sapien
ataatagtacagctccraaggtagaatcatcac

SEQ ID NO: 7529 - DNA, 33 bp, homo sapien
aagagctgcaagagacmaggaatatcatgaaca

SEQ ID NO: 7530 - DNA, 33 bp, homo sapien
tgaacctgtagcaggakaaaggcacttggttag

SEQ ID NO: 7531 - DNA, 33 bp, homo sapien
tgttttcatagtaaccrttgcattttttgtctt

SEQ ID NO: 7532 - DNA, 33 bp, homo sapien
tttctagttttttatcrtgtgatattctgtttt

SEQ ID NO: 7533 - DNA, 33 bp, homo sapien
aatctcaactaatactstgcttttggttaagaa

SEQ ID NO: 7534 - DNA, 33 bp, homo sapien
aacattttctcagatayaggacatataaacaca

SEQ ID NO: 7535 - DNA, 33 bp, homo sapien
aactactggggaatccyttacatttcagtgaca

SEQ ID NO: 7536 - DNA, 33 bp, homo sapien
ccaatgccacaacatgrctggaatgctcagaca

SEQ ID NO: 7537 - DNA, 33 bp, homo sapien
tggccagaaagtaaccygaggacttgaaggaaa

SEQ ID NO: 7538 - DNA, 33 bp, homo sapien
acacaaccttcctttcyttaacgtaccaaaagt

SEQ ID NO: 7539 - DNA, 33 bp, homo sapien
gtgcataatgtgatagmcaagaaacaggagaaa

SEQ ID NO: 7540 - DNA, 33 bp, homo sapien
tgtctcatgaatatcasatccaaaacctagtat

SEQ ID NO: 7541 - DNA, 33 bp, homo sapien
attttggcaaagcaagrcaccctagtaaaatgt

SEQ ID NO: 7542 - DNA, 33 bp, homo sapien
ggaatcctttaaatcaygaaaagcccacttggt

SEQ ID NO: 7543 - DNA, 33 bp, homo sapien
tagttatttgctcaagraaaatgaaattacatc

SEQ ID NO: 7544 - DNA, 33 bp, homo sapien
cagcacatgtgtcctgmagaaatgacgaccagt

SEQ ID NO: 7545 - DNA, 33 bp, homo sapien
tgtgtgacttatcttaracagcatctactttgt

SEQ ID NO: 7546 - DNA, 33 bp, homo sapien
atttagatgttcaaaayttttcacttagttaat

SEQ ID NO: 7547 - DNA, 33 bp, homo sapien
attttgaagaccatttrcttacaagtgcaaaac

SEQ ID NO: 7548 - DNA, 33 bp, homo sapien
atttcttcagtgatacragaatcttagagttag

SEQ ID NO: 7549 - DNA, 33 bp, homo sapien
cctcacaatgaaggttyggattgtggcatcttg

SEQ ID NO: 7550 - DNA, 33 bp, homo sapien
aggcctatagtgaaaawccgaatattccaagac

SEQ ID NO: 7551 - DNA, 33 bp, homo sapien
tcttcagggcattttgrtaaataaaggaaagca

SEQ ID NO: 7552 - DNA, 33 bp, homo sapien
gatactaaggctcggcrtcctttaacctgtcat

SEQ ID NO: 7553 - DNA, 33 bp, homo sapien
catatttttctgctaamaggaaaggccactgac

SEQ ID NO: 7554 - DNA, 33 bp, homo sapien
gatttatcccagacatkcaaggagattcaacat

SEQ ID NO: 7555 - DNA, 33 bp, homo sapien
gacccattcctgcacawccatctggcaaactcc

SEQ ID NO: 7556 - DNA, 33 bp, homo sapien
ccttctctgcctatacmtgggtccagactccat

SEQ ID NO: 7557 - DNA, 33 bp, homo sapien
gaaggccatcttgtacygcaaacaaaaaaaaca

SEQ ID NO: 7558 - DNA, 33 bp, homo sapien
aattgtgctcaaacatrttcataaagcagaaca

SEQ ID NO: 7559 - DNA, 33 bp, homo sapien
tcaacaagtatagtttytaagcctttaagaaga

SEQ ID NO: 7560 - DNA, 33 bp, homo sapien
ttcaacaataccagtakcaagtcagtttctgaa

SEQ ID NO: 7561 - DNA, 33 bp, homo sapien
atgcctggaattgacastgttgcttctgtcata

SEQ ID NO: 7562 - DNA, 33 bp, homo sapien
aggtacgttaggctctratgaaacctcagcaga

SEQ ID NO: 7563 - DNA, 33 bp, homo sapien
ctttcctggacttcccrctcttgttagctgact

SEQ ID NO: 7564 - DNA, 33 bp, homo sapien
aggctgacttggatggmctacatcaccaaggtt

SEQ ID NO: 7565 - DNA, 33 bp, homo sapien
tatcataaaattgactmtggtaggagaatttat

SEQ ID NO: 7566 - DNA, 33 bp, homo sapien
aaacttcttatttgatycatgtgttacttagaa

SEQ ID NO: 7567 - DNA, 33 bp, homo sapien
aaatctttttcccgttsaatctatcttatgagt

SEQ ID NO: 7568 - DNA, 33 bp, homo sapien
tgctaaaggttggggcwtgcatcctctgaagcc

SEQ ID NO: 7569 - DNA, 33 bp, homo sapien
atgaacacagttggatrccaatacagcaggatc

SEQ ID NO: 7570 - DNA, 33 bp, homo sapien
tcataagtgctctaggrcataaccaataagcag

SEQ ID NO: 7571 - DNA, 33 bp, homo sapien
ttcacagattcgttcayttgaacatcatagcag

SEQ ID NO: 7572 - DNA, 33 bp, homo sapien
ctacagcagccaaaccsagacagaggtgatgtg

SEQ ID NO: 7573 - DNA, 33 bp, homo sapien
ctcttcttcaaggatarcatccctttgctgtgc

SEQ ID NO: 7574 - DNA, 33 bp, homo sapien
tggacttaaaattgacscttgagcgattagacc

SEQ ID NO: 7575 - DNA, 33 bp, homo sapien
aggaaaatgcaggaaaygctgaggctttgaaga

SEQ ID NO: 7576 - DNA, 33 bp, homo sapien
ttctggtaagattcagraaaaaatgaagaacat

SEQ ID NO: 7577 - DNA, 33 bp, homo sapien
ctgacaacactatgccytttcactctttgtctt

SEQ ID NO: 7578 - DNA, 33 bp, homo sapien
acagaaagaaactcagktttggcatgtcatgcc

SEQ ID NO: 7579 - DNA, 33 bp, homo sapien
ctaatttcgccgattcrttaaaataatcgactt

SEQ ID NO: 7580 - DNA, 33 bp, homo sapien
ctccttcaagtagtcgrtaattggacctgattc

SEQ ID NO: 7581 - DNA, 33 bp, homo sapien
aagcatctcaaataaartatttcaaaactcagc

SEQ ID NO: 7582 - DNA, 33 bp, homo sapien
attggccaaaatatggrccaaaactcaggtgga

SEQ ID NO: 7583 - DNA, 33 bp, homo sapien
agatcggtgttggtcaygcccaagacaaaactc

SEQ ID NO: 7584 - DNA, 33 bp, homo sapien
agtgataaaaactcaarcgagtagtaacaaaga

SEQ ID NO: 7585 - DNA, 33 bp, homo sapien
aattttcctttctcagycgtcttctacctccag

SEQ ID NO: 7586 - DNA, 33 bp, homo sapien
cagcccagatattcctyacctatggtttttgta

SEQ ID NO: 7587 - DNA, 33 bp, homo sapien
ctacatgccttgatgayactcgttttgtatagt

SEQ ID NO: 7588 - DNA, 33 bp, homo sapien
gaggaaggaagtaaggrtgatcagagccctaga

SEQ ID NO: 7589 - DNA, 33 bp, homo sapien
gagtgggaagactcatktgagttcagagtactc

SEQ ID NO: 7590 - DNA, 33 bp, homo sapien
taaatcttcagacacaraagtgcaaacaaaagg

SEQ ID NO: 7591 - DNA, 33 bp, homo sapien
ggtactcacaattcagyatacccagtttaagtg

SEQ ID NO: 7592 - DNA, 33 bp, homo sapien
ctttaaatttattaccrcaaacctccagtgggc

SEQ ID NO: 7593 - DNA, 33 bp, homo sapien
ctctttttattcaacgkgttcacaagtttttag

SEQ ID NO: 7594 - DNA, 33 bp, homo sapien
aaaacgagttataacckctgcaccttacaaacc

SEQ ID NO: 7595 - DNA, 33 bp, homo sapien
tctctgaggtgaagttygaaggatcactcgtgc

SEQ ID NO: 7596 - DNA, 33 bp, homo sapien
atgtctctcaactgtaygtcagaagtcccactt

SEQ ID NO: 7597 - DNA, 33 bp, homo sapien
ttctttcattgtgggarttttaagcattttatc

SEQ ID NO: 7598 - DNA, 33 bp, homo sapien
ccagtgaatggagtccrcggatgttgctaaata

SEQ ID NO: 7599 - DNA, 33 bp, homo sapien
aaggtctgcccattccmgaacattcatctttga

SEQ ID NO: 7600 - DNA, 33 bp, homo sapien
atgtactgcagtctatratatataacccttgca

SEQ ID NO: 7601 - DNA, 33 bp, homo sapien
cccaactaaactggcamaatgtcttatgagtcc

SEQ ID NO: 7602 - DNA, 33 bp, homo sapien
ctggctgcgccatctgytcctgacattaagctc

SEQ ID NO: 7603 - DNA, 33 bp, homo sapien
agggaacctgattttaygaatagtttccatctc

SEQ ID NO: 7604 - DNA, 33 bp, homo sapien
tgcaagctactacttamtactgagccaagtaac

SEQ ID NO: 7605 - DNA, 33 bp, homo sapien
tgatgatgccaaattcrggaaattaacaaaaag

SEQ ID NO: 7606 - DNA, 33 bp, homo sapien
tgagccttatgctatgsgagccactatgaagat

SEQ ID NO: 7607 - DNA, 33 bp, homo sapien
atgcttactaattataygaagtcctttgaaatg

SEQ ID NO: 7608 - DNA, 33 bp, homo sapien
ttggctcttttgtcagrcagcatgttcttattt

SEQ ID NO: 7609 - DNA, 33 bp, homo sapien
tttaaacatttttgaaratacggtctctgttct

SEQ ID NO: 7610 - DNA, 33 bp, homo sapien
atgtccatttcttcacyatggggtaacatctag

SEQ ID NO: 7611 - DNA, 33 bp, homo sapien
tatggagtttctgcaawgccattaaaaatgagc

SEQ ID NO: 7612 - DNA, 33 bp, homo sapien
tcatccacccattcacrcttgtactttttttat

SEQ ID NO: 7613 - DNA, 33 bp, homo sapien
tgtccattataattccrtatgttgtatcttctg

SEQ ID NO: 7614 - DNA, 33 bp, homo sapien
tgctatttccaagtggktatagcaagctggcaa

SEQ ID NO: 7615 - DNA, 33 bp, homo sapien
tattatgaacagctatwtactcacaaaccagaa

SEQ ID NO: 7616 - DNA, 33 bp, homo sapien
gtggtgttggcctgtakattgggtgtgcaggtg

SEQ ID NO: 7617 - DNA, 33 bp, homo sapien
aggctgatgaggggttwgcacggaagaattgag

SEQ ID NO: 7618 - DNA, 33 bp, homo sapien
ctctagtgcctacacaygccttttgagaaacac

SEQ ID NO: 7619 - DNA, 33 bp, homo sapien
aggccctgagtgagaamtgtcaaattgaactat

SEQ ID NO: 7620 - DNA, 33 bp, homo sapien
cccaaattcagaggatraattaatctcttcaac

SEQ ID NO: 7621 - DNA, 33 bp, homo sapien
ccagctttggcacttgytgttcctccagcctgg

SEQ ID NO: 7622 - DNA, 33 bp, homo sapien
agaattgcctggaaatktgacggtccgggaata

SEQ ID NO: 7623 - DNA, 33 bp, homo sapien
gccactctccttgccayggaatttgctggcggg

SEQ ID NO: 7624 - DNA, 33 bp, homo sapien
aattttcacagtttttrtctatctgaagttgtg

SEQ ID NO: 7625 - DNA, 33 bp, homo sapien
tccacttctgaaatgcractttctggaacaaaa

SEQ ID NO: 7626 - DNA, 33 bp, homo sapien
ctggctttctacaagarcttcattttatgcatc

SEQ ID NO: 7627 - DNA, 33 bp, homo sapien
tgtcttatggtgaaagsagatgaaacctgaagc

SEQ ID NO: 7628 - DNA, 33 bp, homo sapien
tgcttaaatgccttgcytttcaatctttcactg

SEQ ID NO: 7629 - DNA, 33 bp, homo sapien
tcagagtcttagagatrgtatcccaggtgactt

SEQ ID NO: 7630 - DNA, 33 bp, homo sapien
gtattttcaaataatgycaggaaatgcattttt

SEQ ID NO: 7631 - DNA, 33 bp, homo sapien
ttaacaaagaaacaaayggagaccaaaataagc

SEQ ID NO: 7632 - DNA, 33 bp, homo sapien
cctggtacttgcatccwagaggtccagccaata

SEQ ID NO: 7633 - DNA, 33 bp, homo sapien
gttctcagtcgtgtttstctaatgagatgatgt

SEQ ID NO: 7634 - DNA, 33 bp, homo sapien
ccctctcccatcgattscaacttttcccctcct

SEQ ID NO: 7635 - DNA, 33 bp, homo sapien
cactacttcagatcctygagtgctaacattatg

SEQ ID NO: 7636 - DNA, 33 bp, homo sapien
cctgctgccatttgtcytccaaacttctcaaaa

SEQ ID NO: 7637 - DNA, 33 bp, homo sapien
aaggaaatgtccataayatgaattaatactgcc

SEQ ID NO: 7638 - DNA, 33 bp, homo sapien
ttttcctcccaggagartgtgtatttttaaagc

SEQ ID NO: 7639 - DNA, 33 bp, homo sapien
atggcaagtttctggtmttcaacaaaatatccc

SEQ ID NO: 7640 - DNA, 33 bp, homo sapien
attaagtctttaccaaytcagtcaatgtcatca

SEQ ID NO: 7641 - DNA, 33 bp, homo sapien
aaaatgcttccaatatytctagtacatgatatt

SEQ ID NO: 7642 - DNA, 33 bp, homo sapien
ctgatgaaggctcactstactttcaagatggta

SEQ ID NO: 7643 - DNA, 33 bp, homo sapien
aagcaaaggctagaatraaaacctccatgactt

SEQ ID NO: 7644 - DNA, 33 bp, homo sapien
tcttctggctctgagawtatcttcatgccacgc

SEQ ID NO: 7645 - DNA, 33 bp, homo sapien
tgttgaagaccttgccrtgttaagtgatgtaga

SEQ ID NO: 7646 - DNA, 33 bp, homo sapien
atattcaatgaaattcrgaagatgtaagacaag

SEQ ID NO: 7647 - DNA, 33 bp, homo sapien
gaactttatattagacrcaagtacttaggcagc

SEQ ID NO: 7648 - DNA, 33 bp, homo sapien
cttgccagagctaagcrttgttgggctataaaa

SEQ ID NO: 7649 - DNA, 33 bp, homo sapien
aaggtacaagggaacayataaactgaggataaa

SEQ ID NO: 7650 - DNA, 33 bp, homo sapien
caaaatatcacactagycatttccacaactggc

SEQ ID NO: 7651 - DNA, 33 bp, homo sapien
gttggtgtaaacataaytgccattttttgctat

SEQ ID NO: 7652 - DNA, 33 bp, homo sapien
actgtgccttgaggaayggtgcactgtggccca

SEQ ID NO: 7653 - DNA, 33 bp, homo sapien
atgtatttctctctcaygttatatgtgtgcttg

SEQ ID NO: 7654 - DNA, 33 bp, homo sapien
atattcaggactgaaaygttatgtaactttaag

SEQ ID NO: 7655 - DNA, 33 bp, homo sapien
aaacttctcaaagtccmtaacatttatctgaca

SEQ ID NO: 7656 - DNA, 33 bp, homo sapien
tacattaagtaattcartggaaacataccttct

SEQ ID NO: 7657 - DNA, 33 bp, homo sapien
gcttggaaaactcaaarcatccacgggtaacag

SEQ ID NO: 7658 - DNA, 33 bp, homo sapien
agaaaagaaataagatyggagaagaacaaaatg

SEQ ID NO: 7659 - DNA, 33 bp, homo sapien
ctgcattaaaggttgakttttccttagtgctca

SEQ ID NO: 7660 - DNA, 33 bp, homo sapien
agaacttaggggcaaaytgattgcatccgatcc

SEQ ID NO: 7661 - DNA, 33 bp, homo sapien
cagtctgtaatgaatcrgttgaattcagagaca

SEQ ID NO: 7662 - DNA, 33 bp, homo sapien
tcatcttggggcaggaygttctccttctgtaag

SEQ ID NO: 7663 - DNA, 33 bp, homo sapien
gttatcttcaggttagrttgtcactgtggaagt

SEQ ID NO: 7664 - DNA, 33 bp, homo sapien
tgactaactgtacctgrgcagtgctgaaaacac

SEQ ID NO: 7665 - DNA, 33 bp, homo sapien
caataccagtgatataygagggctgaaaatttc

SEQ ID NO: 7666 - DNA, 33 bp, homo sapien
attttgtgcgctttttscaagtgtgctgtattt

SEQ ID NO: 7667 - DNA, 33 bp, homo sapien
gaaggagaacttagtcygagtaaaggtcacaag

SEQ ID NO: 7668 - DNA, 33 bp, homo sapien
actgctacccatcagcwgtgagttccaaaggtc

SEQ ID NO: 7669 - DNA, 33 bp, homo sapien
atgtacacattcatctsttcttatgggaattac

SEQ ID NO: 7670 - DNA, 33 bp, homo sapien
gatttgcctgactataktaaccatttcacaaca

SEQ ID NO: 7671 - DNA, 33 bp, homo sapien
tcacactgacagcaatrcatttccctctaagga

SEQ ID NO: 7672 - DNA, 33 bp, homo sapien
agcttgatgtgtctgarggctgcacataggttg

SEQ ID NO: 7673 - DNA, 33 bp, homo sapien
cttgctccatatttttkccagtatgtagtggtg

SEQ ID NO: 7674 - DNA, 33 bp, homo sapien
aaaagtctgactcaaargcgcactgtcacaata

SEQ ID NO: 7675 - DNA, 33 bp, homo sapien
tcctgaatgatttctargtaaacaacaaaatta

SEQ ID NO: 7676 - DNA, 33 bp, homo sapien
gaattccattttgaatyggtgctactttgaatt

SEQ ID NO: 7677 - DNA, 33 bp, homo sapien
gatcggctgaccctgcytctgacccttttagac

SEQ ID NO: 7678 - DNA, 33 bp, homo sapien
ggtttgagcagcactcygccagtgaccttctga

SEQ ID NO: 7679 - DNA, 33 bp, homo sapien
aaggtaggaaatagcayggtgagtaagaaatat

SEQ ID NO: 7680 - DNA, 33 bp, homo sapien
aaaagaagaaaatataygctatcacaggaacac

SEQ ID NO: 7681 - DNA, 33 bp, homo sapien
cacataaagcctgtgcrttataagcaggatacg

SEQ ID NO: 7682 - DNA, 33 bp, homo sapien
atttctccgctatccawttcagcccctctctcc

SEQ ID NO: 7683 - DNA, 33 bp, homo sapien
tacatacttatgcataktctctttgtgaaaata

SEQ ID NO: 7684 - DNA, 33 bp, homo sapien
atgctgaatattgtgcrtgacacctagaaaaca

SEQ ID NO: 7685 - DNA, 33 bp, homo sapien
taaattagtaaatagaraatccgtggacatgag

SEQ ID NO: 7686 - DNA, 33 bp, homo sapien
gaagccaagctgatgtwttggtattgtgcttat

SEQ ID NO: 7687 - DNA, 33 bp, homo sapien
tatggtatgttttataygtatcctagtagagag

SEQ ID NO: 7688 - DNA, 33 bp, homo sapien
ataaaggaacagggaawtaatgagtcccatgga

SEQ ID NO: 7689 - DNA, 33 bp, homo sapien
tacagagggccactacyttctgagaaacagttt

SEQ ID NO: 7690 - DNA, 33 bp, homo sapien
ggacaaatatactcctsagtccatgaaaccaaa

SEQ ID NO: 7691 - DNA, 33 bp, homo sapien
agtgctaccagtgcatygctaaggcttctaaaa

SEQ ID NO: 7692 - DNA, 33 bp, homo sapien
ctgtgctacctcttgcytaaatgtgttctttta

SEQ ID NO: 7693 - DNA, 33 bp, homo sapien
aacatttgagttgtttycatattttagctattg

SEQ ID NO: 7694 - DNA, 33 bp, homo sapien
tggcttgggtggtggcwacacagacttgtttgg

SEQ ID NO: 7695 - DNA, 33 bp, homo sapien
tggcatatagtaagcamtgaaaagtagtaaaaa

SEQ ID NO: 7696 - DNA, 33 bp, homo sapien
tgttaacatcaagcttstaggatagtttgttgc

SEQ ID NO: 7697 - DNA, 33 bp, homo sapien
aagtcagtgatgttttmtatactgtcagcagca

SEQ ID NO: 7698 - DNA, 33 bp, homo sapien
ctcttgtattcattgartggctattactgagca

SEQ ID NO: 7699 - DNA, 33 bp, homo sapien
tccaatgcaagttttcmgcttattggcacatct

SEQ ID NO: 7700 - DNA, 33 bp, homo sapien
tgcagtatcatttatcmtgagaagtgctgggtg

SEQ ID NO: 7701 - DNA, 33 bp, homo sapien
atctgttctaggatacmacaagaaggatccacg

SEQ ID NO: 7702 - DNA, 33 bp, homo sapien
gattaacatgcagattygttttcacccttgagt

SEQ ID NO: 7703 - DNA, 33 bp, homo sapien
tttatacgatgaaaackatatgataaaaaggga

SEQ ID NO: 7704 - DNA, 33 bp, homo sapien
ttgtgtttttttccctwcagaatgattgagtct

SEQ ID NO: 7705 - DNA, 33 bp, homo sapien
gctagaaaaaccctgcrtctatgagctttacct

SEQ ID NO: 7706 - DNA, 33 bp, homo sapien
ggaaagactatttttcyatataaacgaatccat

SEQ ID NO: 7707 - DNA, 33 bp, homo sapien
ctcctctgtctctctaycttttcaccaaaatct

SEQ ID NO: 7708 - DNA, 33 bp, homo sapien
cttatttattttccacrtaaatccatcaaactc

SEQ ID NO: 7709 - DNA, 33 bp, homo sapien
attctgaacacctactrtgagtcacgagccagg

SEQ ID NO: 7710 - DNA, 33 bp, homo sapien
taagggtctaaggtccrgaaggtagtgatccac

SEQ ID NO: 7711 - DNA, 33 bp, homo sapien
gaaaaaaatccatgtamaagtgaatctatgcag

SEQ ID NO: 7712 - DNA, 33 bp, homo sapien
ctgagaaatgatcaggytaaatcgccaggtcag

SEQ ID NO: 7713 - DNA, 33 bp, homo sapien
aggagaatttggagagktataaaatgaggtctg

SEQ ID NO: 7714 - DNA, 33 bp, homo sapien
aggcatggggtaccttyatcggactcatcaaaa

SEQ ID NO: 7715 - DNA, 33 bp, homo sapien
tagaagatctaaatgargaaaatgatttgcctc

SEQ ID NO: 7716 - DNA, 33 bp, homo sapien
ctttcaagtgggaatarcaatgcccatcatcca

SEQ ID NO: 7717 - DNA, 33 bp, homo sapien
tgtgtttgtgcaaatcytaggtgctcaataaat

SEQ ID NO: 7718 - DNA, 33 bp, homo sapien
tagtgttctccagaggmcactgctctgtaccag

SEQ ID NO: 7719 - DNA, 33 bp, homo sapien
agcaggtttgattttaygcaagaaaccataaag

SEQ ID NO: 7720 - DNA, 33 bp, homo sapien
atttataagtgctgtawtgaaaagaaagagact

SEQ ID NO: 7721 - DNA, 33 bp, homo sapien
agctgctgggctctttytgtttgtcatcactgt

SEQ ID NO: 7722 - DNA, 33 bp, homo sapien
actcttccattaattgygtctcttttctattta

SEQ ID NO: 7723 - DNA, 33 bp, homo sapien
ggagatttttaaaattkctcatgctggcttccc

SEQ ID NO: 7724 - DNA, 33 bp, homo sapien
ccctgctttctttctaygccctgaagatgaaac

SEQ ID NO: 7725 - DNA, 33 bp, homo sapien
ttgccttgctttaagayagtcctctgatacctg

SEQ ID NO: 7726 - DNA, 33 bp, homo sapien
aagattctcgatgggayatatgaagacaattat

SEQ ID NO: 7727 - DNA, 33 bp, homo sapien
tgctgtaacaaagtttygctaattaagtagcat

SEQ ID NO: 7728 - DNA, 33 bp, homo sapien
agaattctggtacaagyctaattggaaaaaagt

SEQ ID NO: 7729 - DNA, 33 bp, homo sapien
tcttagttgagtcctcygaatgaaaaggccaga

SEQ ID NO: 7730 - DNA, 33 bp, homo sapien
gaaggacgtgttgctcraagttgaagagatcag

SEQ ID NO: 7731 - DNA, 33 bp, homo sapien
gatcaaagtaaataaartggaacactgttgatg

SEQ ID NO: 7732 - DNA, 33 bp, homo sapien
tgagcttctgaaatgcraaactatggattaatt

SEQ ID NO: 7733 - DNA, 33 bp, homo sapien
tcttcttcagatcctcytcactggctgttgaga

SEQ ID NO: 7734 - DNA, 33 bp, homo sapien
tatcaaaaccctgtgcrtacttcaagcctcatc

SEQ ID NO: 7735 - DNA, 33 bp, homo sapien
gtggcttttctttcacrggtatgaaggttgact

SEQ ID NO: 7736 - DNA, 33 bp, homo sapien
tctagtgttgatctgakaacataactcttttct

SEQ ID NO: 7737 - DNA, 33 bp, homo sapien
tctcaagcacttgtaargaaacacaaggggtgg

SEQ ID NO: 7738 - DNA, 33 bp, homo sapien
aaggacttatgattgcyctcattacgtagatgg

SEQ ID NO: 7739 - DNA, 33 bp, homo sapien
gtggcagtgacatattyggtgttcacattgaaa

SEQ ID NO: 7740 - DNA, 33 bp, homo sapien
tgaacattaggaagagyctactgaggtctggat

SEQ ID NO: 7741 - DNA, 33 bp, homo sapien
ctctctgcgtccacctyttctcttgttatccca

SEQ ID NO: 7742 - DNA, 33 bp, homo sapien
ggaatggtaactacatygtctgaaaggaagtag

SEQ ID NO: 7743 - DNA, 33 bp, homo sapien
gctttgttaacttagcytcttcctctatggaga

SEQ ID NO: 7744 - DNA, 33 bp, homo sapien
acctaatgagactacamacaatccagcctctac

SEQ ID NO: 7745 - DNA, 33 bp, homo sapien
atgaagacaattgaccractgtgcgtggaatca

SEQ ID NO: 7746 - DNA, 33 bp, homo sapien
aagagtgtcattgcaayagtaaattcaaagatc

SEQ ID NO: 7747 - DNA, 33 bp, homo sapien
tgcttgtttcagttagyattttcagcttcccaa

SEQ ID NO: 7748 - DNA, 33 bp, homo sapien
acactgcagtgtcatgmccttagcttctttaaa

SEQ ID NO: 7749 - DNA, 33 bp, homo sapien
gactgagacaaatttamgtattagttggcagct

SEQ ID NO: 7750 - DNA, 33 bp, homo sapien
tgctgaatgtgtcagtytctctgaacttcaatt

SEQ ID NO: 7751 - DNA, 33 bp, homo sapien
gcctctgctcaattgaygtctcaggatagctct

SEQ ID NO: 7752 - DNA, 33 bp, homo sapien
acaaagtattacctcasttgccgcttattttag

SEQ ID NO: 7753 - DNA, 33 bp, homo sapien
ttttaatttcttttccstgatgacatatgatgc

SEQ ID NO: 7754 - DNA, 33 bp, homo sapien
actcaataattctatcmttttgtcaaagcatta

SEQ ID NO: 7755 - DNA, 33 bp, homo sapien
ataaaacataaaatcartacacagtggatcaga

SEQ ID NO: 7756 - DNA, 33 bp, homo sapien
gtggcagtggatactcycgatgttcaaaaagat

SEQ ID NO: 7757 - DNA, 33 bp, homo sapien
ttaagagatcaaccttkaagtgacatacaaaat

SEQ ID NO: 7758 - DNA, 33 bp, homo sapien
tctattcaggagcctgytgggtgattcacattt

SEQ ID NO: 7759 - DNA, 33 bp, homo sapien
tctcatgggcagtctcwttttctagaacatcca

SEQ ID NO: 7760 - DNA, 33 bp, homo sapien
tataattcacaatgtcrtagaatgctaaatgcg

SEQ ID NO: 7761 - DNA, 33 bp, homo sapien
gtacaggcatacctcawtttatttcacttggtt

SEQ ID NO: 7762 - DNA, 33 bp, homo sapien
tggtttttgtagagacraggtcttcctatgttg

SEQ ID NO: 7763 - DNA, 33 bp, homo sapien
gcggggcctgggcgccrgccaagacttgcagcg

SEQ ID NO: 7764 - DNA, 33 bp, homo sapien
tagcatacctgttgaaygaaacattttcatgaa

SEQ ID NO: 7765 - DNA, 33 bp, homo sapien
tgtcatgttaaacattstgtagttaacaccact

SEQ ID NO: 7766 - DNA, 33 bp, homo sapien
attatctggagtcaggrttcttctttagcagtg

SEQ ID NO: 7767 - DNA, 33 bp, homo sapien
taggtcttcaagacacrgtcatcatcaatgaat

SEQ ID NO: 7768 - DNA, 33 bp, homo sapien
tgctcacatggtctttycttggtgtgtgcatga

SEQ ID NO: 7769 - DNA, 33 bp, homo sapien
cagaagacaagagaagsctgtaaatccgttatg

SEQ ID NO: 7770 - DNA, 33 bp, homo sapien
tttcatattagacctgygttctacctaactgat

SEQ ID NO: 7771 - DNA, 33 bp, homo sapien
aggacaggagacaaggkttagagactattgaga

SEQ ID NO: 7772 - DNA, 33 bp, homo sapien
cacagcctacatcacasccgaacaggcaaaagc

SEQ ID NO: 7773 - DNA, 33 bp, homo sapien
gcaccacatacagaaaycaatccaaaaaggata

SEQ ID NO: 7774 - DNA, 33 bp, homo sapien
aactggactttcttggmggtagatgccacatgt

SEQ ID NO: 7775 - DNA, 33 bp, homo sapien
aagcagttcaatcccartagtttcttgatctat

SEQ ID NO: 7776 - DNA, 33 bp, homo sapien
atgttctactctgtctkcagatttaaatgttaa

SEQ ID NO: 7777 - DNA, 33 bp, homo sapien
ggcttatgaagtgatgygataacagctcctttt

SEQ ID NO: 7778 - DNA, 33 bp, homo sapien
gtactgggtttcaagaytaggaccaagaaatgt

SEQ ID NO: 7779 - DNA, 33 bp, homo sapien
taatcaattaggactayagtttcttgatgtatc

SEQ ID NO: 7780 - DNA, 33 bp, homo sapien
ttaacattgctgtcatkaaaagtagtataaatt

SEQ ID NO: 7781 - DNA, 33 bp, homo sapien
aatacaggaaaatcacytgatgaagcatttata

SEQ ID NO: 7782 - DNA, 33 bp, homo sapien
agctcaacagatcctcrtgattttaccaaagat

SEQ ID NO: 7783 - DNA, 33 bp, homo sapien
tttagtgtttcaaattyccagaagaccttacta

SEQ ID NO: 7784 - DNA, 33 bp, homo sapien
aaaagtaggttatacartggaaaacaacaacca

SEQ ID NO: 7785 - DNA, 33 bp, homo sapien
tctttgcatgtacacawtatgttttctttatcc

SEQ ID NO: 7786 - DNA, 33 bp, homo sapien
ctgacacattccctgtyaatttcttgagtttct

SEQ ID NO: 7787 - DNA, 33 bp, homo sapien
aaactctgcctaagacrccacactctgttggaa

SEQ ID NO: 7788 - DNA, 33 bp, homo sapien
atttattttttgagacygaattttgctcgtctc

SEQ ID NO: 7789 - DNA, 33 bp, homo sapien
tcccaaacacactttaraaacacagaatatttt

SEQ ID NO: 7790 - DNA, 33 bp, homo sapien
cttgaatgaccaggtaygctgtcaatgagcagt

SEQ ID NO: 7791 - DNA, 33 bp, homo sapien
gtacagtgtttgtgttktacgctgttattgtga

SEQ ID NO: 7792 - DNA, 33 bp, homo sapien
attaatgagcctataasctctgttgttttcctt

SEQ ID NO: 7793 - DNA, 33 bp, homo sapien
taatagtaggaataaarccaaaaaagatcattc

SEQ ID NO: 7794 - DNA, 33 bp, homo sapien
ccacaagaaattctggscagcatcaggaaccaa

SEQ ID NO: 7795 - DNA, 33 bp, homo sapien
tttcattctttagctgrtaagttgattaaagta

SEQ ID NO: 7796 - DNA, 33 bp, homo sapien
aaaagttaatgttgttkgttctatttatgttat

SEQ ID NO: 7797 - DNA, 33 bp, homo sapien
caagccatgaaaatttwaaaggactagaatgaa

SEQ ID NO: 7798 - DNA, 33 bp, homo sapien
agaaaatcaggatattkgtggaactaggagttt

SEQ ID NO: 7799 - DNA, 33 bp, homo sapien
tataatagaattcaggwactcagttgaagtatt

SEQ ID NO: 7800 - DNA, 33 bp, homo sapien
atcactgtagacttttycagataggataatttc

SEQ ID NO: 7801 - DNA, 33 bp, homo sapien
ctatcttccagcctttytattgaagttttcaat

SEQ ID NO: 7802 - DNA, 33 bp, homo sapien
tggtatgctaaatttcrggccttgtggcactct

SEQ ID NO: 7803 - DNA, 33 bp, homo sapien
atgaatatcggtgtatwtcaaattttcctgggt

SEQ ID NO: 7804 - DNA, 33 bp, homo sapien
cattccaatgccaaaayggaaagtcaagattct

SEQ ID NO: 7805 - DNA, 33 bp, homo sapien
gcttcactttcttaccrtacacgacagggttgt

SEQ ID NO: 7806 - DNA, 33 bp, homo sapien
gtcgtagcatacaagayagcatctctgtctttc

SEQ ID NO: 7807 - DNA, 33 bp, homo sapien
tccaacgaacatgcacyctttagctgctcttcc

SEQ ID NO: 7808 - DNA, 33 bp, homo sapien
agttctctgtggagatkatagcaattcatggga

SEQ ID NO: 7809 - DNA, 33 bp, homo sapien
caaaatgtcttatcatrtcttactctcccatct

SEQ ID NO: 7810 - DNA, 33 bp, homo sapien
tctatgctggtatgtcratattttagatgccaa

SEQ ID NO: 7811 - DNA, 33 bp, homo sapien
gaaggcactccagtccscaaagattgatctcac

SEQ ID NO: 7812 - DNA, 33 bp, homo sapien
gaagtgaatcttatgastcttaacctctcctaa

SEQ ID NO: 7813 - DNA, 33 bp, homo sapien
cggtcctgaacagagakacagtcgtctgtgagc

SEQ ID NO: 7814 - DNA, 33 bp, homo sapien
aattttaatttccagartctctttgatcgctcc

SEQ ID NO: 7815 - DNA, 33 bp, homo sapien
cttaaccttgagatcaraaacataaaagaagca

SEQ ID NO: 7816 - DNA, 33 bp, homo sapien
gtgagaaatgatattcrccgccgactgcccaac

SEQ ID NO: 7817 - DNA, 33 bp, homo sapien
caccccctactcagccratgtggtaagcattta

SEQ ID NO: 7818 - DNA, 33 bp, homo sapien
ttttgtgactgagtctygctccaaggctagagt

SEQ ID NO: 7819 - DNA, 33 bp, homo sapien
accaaataccagacacrcagtttcttgacagat

SEQ ID NO: 7820 - DNA, 33 bp, homo sapien
cctcctctaagtggaawccacaagcctcccacc

SEQ ID NO: 7821 - DNA, 33 bp, homo sapien
ttccattgcagttcccygtaaatagggtgactg

SEQ ID NO: 7822 - DNA, 33 bp, homo sapien
gggagaaagatggaggycaaaagactaagccag

SEQ ID NO: 7823 - DNA, 33 bp, homo sapien
caaagatgaaatccatraaggtcagagcccagg

SEQ ID NO: 7824 - DNA, 33 bp, homo sapien
ataagaaagtgagggcragaacagaaaccatag

SEQ ID NO: 7825 - DNA, 33 bp, homo sapien
aaagcactttcacctgkgttatctcattcgatc

SEQ ID NO: 7826 - DNA, 33 bp, homo sapien
tggtattggctgggacyggtcatgtgtctgtgg

SEQ ID NO: 7827 - DNA, 33 bp, homo sapien
tccaaatgatgctataygctttatatatttttc

SEQ ID NO: 7828 - DNA, 33 bp, homo sapien
taatgttgcataataasccacgaagacaaaatg

SEQ ID NO: 7829 - DNA, 33 bp, homo sapien
gctgacatggcaaggayatcttggtcatcaagt

SEQ ID NO: 7830 - DNA, 33 bp, homo sapien
ctgagtgatacatagamtacaatgaaaatggtg

SEQ ID NO: 7831 - DNA, 33 bp, homo sapien
cacaatggcttcttttygtaaagaggaaggtat

SEQ ID NO: 7832 - DNA, 33 bp, homo sapien
catgtcaaattgtacartaattcccagtgttgg

SEQ ID NO: 7833 - DNA, 33 bp, homo sapien
cagaggaggtaaaaagmtgacaaacagcctggg

SEQ ID NO: 7834 - DNA, 33 bp, homo sapien
ccggtgaaacagcgttyggtggccactgaccgg

SEQ ID NO: 7835 - DNA, 33 bp, homo sapien
tacaacctcattagcaygtcactaactaacttc

SEQ ID NO: 7836 - DNA, 33 bp, homo sapien
cagtgctactgtagagwttcatcggctcctccc

SEQ ID NO: 7837 - DNA, 33 bp, homo sapien
attggttttttggatgygaatggaatgggcagt

SEQ ID NO: 7838 - DNA, 33 bp, homo sapien
atgggtagtgttactcyaaattgctggcttcag

SEQ ID NO: 7839 - DNA, 33 bp, homo sapien
ctcttctcagtctggaygtaggagttggcatta

SEQ ID NO: 7840 - DNA, 33 bp, homo sapien
atactacgcactgtttygtgtaaggctttttcc

SEQ ID NO: 7841 - DNA, 33 bp, homo sapien
acaaaggtcttgcattkctccctccaaaaggtg

SEQ ID NO: 7842 - DNA, 33 bp, homo sapien
gctgtggctgatgaatrgactagctgcttccaa

SEQ ID NO: 7843 - DNA, 33 bp, homo sapien
aagtacagtccacaaayatgagtgtctatttct

SEQ ID NO: 7844 - DNA, 33 bp, homo sapien
tcaattgcagagacaaycaccaatagtgagggt

SEQ ID NO: 7845 - DNA, 33 bp, homo sapien
gggggatctctttttastgaggtatactgtggg

SEQ ID NO: 7846 - DNA, 33 bp, homo sapien
gttgaagggagatcaayatgaaatgaacagaat

SEQ ID NO: 7847 - DNA, 33 bp, homo sapien
tgctaatagaaggacarttctactcagtgaaat

SEQ ID NO: 7848 - DNA, 33 bp, homo sapien
tacatccaggcactatygtagatccagattttg

SEQ ID NO: 7849 - DNA, 33 bp, homo sapien
accaatgcgctttctamtgtctgagtgaaaagt

SEQ ID NO: 7850 - DNA, 33 bp, homo sapien
tgtctttacttgtttgktctgcctgtaacattt

SEQ ID NO: 7851 - DNA, 33 bp, homo sapien
ggaatgagattaagaaytggaataagaattcta

SEQ ID NO: 7852 - DNA, 33 bp, homo sapien
tcaaggtcatttaactwccaggactaattactc

SEQ ID NO: 7853 - DNA, 33 bp, homo sapien
attcccaccaaaggcgrcataaggcactaggca

SEQ ID NO: 7854 - DNA, 33 bp, homo sapien
tagggataaatcagttyagatctaatatttaga

SEQ ID NO: 7855 - DNA, 33 bp, homo sapien
tatgaatagctagatgytaattatttggaatac

SEQ ID NO: 7856 - DNA, 33 bp, homo sapien
tttccacattgtcttcyttgtgctgtgatccct

SEQ ID NO: 7857 - DNA, 33 bp, homo sapien
tccttgttctcttggcmagttcatagtcatttt

SEQ ID NO: 7858 - DNA, 33 bp, homo sapien
agactctgacaatcggrtctccatgaacacatg

SEQ ID NO: 7859 - DNA, 33 bp, homo sapien
catacagtgctataagrcagtggaaagaatgct

SEQ ID NO: 7860 - DNA, 33 bp, homo sapien
tagagacaggagatgaytgacttctcagcttca

SEQ ID NO: 7861 - DNA, 33 bp, homo sapien
tctgtcagtcaaaaggycctaagaggaaagtgg

SEQ ID NO: 7862 - DNA, 33 bp, homo sapien
tagcctgcatgtttctmtaagatggagagtggc

SEQ ID NO: 7863 - DNA, 33 bp, homo sapien
tctgagccagagatcgrcatgcaggatatttat

SEQ ID NO: 7864 - DNA, 33 bp, homo sapien
agtcaaagtccacatgyaagttgagacctggaa

SEQ ID NO: 7865 - DNA, 33 bp, homo sapien
ttctcaatgtctccatktttctttttgttacaa

SEQ ID NO: 7866 - DNA, 33 bp, homo sapien
aaaaaatccataagtcrtttaggagcaaatcta

SEQ ID NO: 7867 - DNA, 33 bp, homo sapien
agaagctggaagcagtsaggaacataagctact

SEQ ID NO: 7868 - DNA, 33 bp, homo sapien
ttgttagagcaataaasattcttcaaactcaat

SEQ ID NO: 7869 - DNA, 33 bp, homo sapien
ttctgcatcagttgatytcttttcatgtttttc

SEQ ID NO: 7870 - DNA, 33 bp, homo sapien
tccatcatagctgttaytgccacttaaagatga

SEQ ID NO: 7871 - DNA, 33 bp, homo sapien
gaatcaaggatgtcatratgtcatgtggatgta

SEQ ID NO: 7872 - DNA, 33 bp, homo sapien
tataaatttaccctgcrtcattttgcatagttc

SEQ ID NO: 7873 - DNA, 33 bp, homo sapien
gatgtgctgagtgatgwtactggcccccaagtg

SEQ ID NO: 7874 - DNA, 33 bp, homo sapien
acacacacactcagccrtatattgatatacacg

SEQ ID NO: 7875 - DNA, 33 bp, homo sapien
gttcaaaaccagcatargcaacagaccccccgc

SEQ ID NO: 7876 - DNA, 33 bp, homo sapien
tagaagtgcgtttaatktagaggtgactttatg

SEQ ID NO: 7877 - DNA, 33 bp, homo sapien
gatattcatgttcttgwctggtttagttacctg

SEQ ID NO: 7878 - DNA, 33 bp, homo sapien
ttgcccaagatagtagwcataaaacaacttcca

SEQ ID NO: 7879 - DNA, 33 bp, homo sapien
tttaccactgatgtcawgattaaaaaattacct

SEQ ID NO: 7880 - DNA, 33 bp, homo sapien
aagttatctatggccarctcatgcacaatactg

SEQ ID NO: 7881 - DNA, 33 bp, homo sapien
gacagatagatgacagrataagaaacaagaatg

SEQ ID NO: 7882 - DNA, 33 bp, homo sapien
gggggatgcacttgaartaaggatctactgtgt

SEQ ID NO: 7883 - DNA, 33 bp, homo sapien
tagtctttatcattttyttacatggctatataa

SEQ ID NO: 7884 - DNA, 33 bp, homo sapien
cagttctagatcttgtrctttaaactctggcct

SEQ ID NO: 7885 - DNA, 33 bp, homo sapien
gatggggactcgagccyagaagatcaggcccta

SEQ ID NO: 7886 - DNA, 33 bp, homo sapien
acaggcatgtgataccrcacgggactcattatt

SEQ ID NO: 7887 - DNA, 33 bp, homo sapien
agcccaggcaaaacttkcaatcccgattgagac

SEQ ID NO: 7888 - DNA, 33 bp, homo sapien
atctgaactaaacaggrtgtgtaagtgggagga

SEQ ID NO: 7889 - DNA, 33 bp, homo sapien
ttgaaattcataacacrcaaatgtaagggaaga

SEQ ID NO: 7890 - DNA, 33 bp, homo sapien
tatttttgacccgtcaytggttgaatccatgaa

SEQ ID NO: 7891 - DNA, 33 bp, homo sapien
ctattgctcccatctgsgcactttgagcttctc

SEQ ID NO: 7892 - DNA, 33 bp, homo sapien
ctcaattttaatcacamggaacaatcagactat

SEQ ID NO: 7893 - DNA, 33 bp, homo sapien
acatctctattccttcmagaaaaaattctccca

SEQ ID NO: 7894 - DNA, 33 bp, homo sapien
ttcagattttgctattyagtatttataattctg

SEQ ID NO: 7895 - DNA, 33 bp, homo sapien
ggcaagcgattgtcctrtgaaagactagggtta

SEQ ID NO: 7896 - DNA, 33 bp, homo sapien
aaggttgcttgacaacrtgctttcccaggggtt

SEQ ID NO: 7897 - DNA, 33 bp, homo sapien
aggaaggaaaacctccraacatcagcaaaggaa

SEQ ID NO: 7898 - DNA, 33 bp, homo sapien
agacagaagatataagmcgaagttcaaatgatg

SEQ ID NO: 7899 - DNA, 33 bp, homo sapien
cttttgcatttgggcckcaaagtaacaacaaca

SEQ ID NO: 7900 - DNA, 33 bp, homo sapien
attccacctttgaatakttgccatctttgacat

SEQ ID NO: 7901 - DNA, 33 bp, homo sapien
agatcataaagttactmagaagaggcaaatgtg

SEQ ID NO: 7902 - DNA, 33 bp, homo sapien
cagaaagctaaataaaygcctatgtactgtggt

SEQ ID NO: 7903 - DNA, 33 bp, homo sapien
taagctctcttcatgcrttctctttcccccctt

SEQ ID NO: 7904 - DNA, 33 bp, homo sapien
ctgcgtcttctctttcwatgtcagaagccagcc

SEQ ID NO: 7905 - DNA, 33 bp, homo sapien
cagctcgtgtggtgacyctgaccctaagaacca

SEQ ID NO: 7906 - DNA, 33 bp, homo sapien
taggccttgataaataytgacaaatagcattac

SEQ ID NO: 7907 - DNA, 33 bp, homo sapien
atacgctcaatactaartagttctcacccattc

SEQ ID NO: 7908 - DNA, 33 bp, homo sapien
actgtgaagccatactrtcaataggagagtgaa

SEQ ID NO: 7909 - DNA, 33 bp, homo sapien
aattaatttcagtcacrtcccaattaatttacc

SEQ ID NO: 7910 - DNA, 33 bp, homo sapien
caatgtagcccaaactsaagaatgagaatgaac

SEQ ID NO: 7911 - DNA, 33 bp, homo sapien
ccagacctcgtccttcragacttcttcattttt

SEQ ID NO: 7912 - DNA, 33 bp, homo sapien
cccaattaaaagtatcyttgcagttttccttaa

SEQ ID NO: 7913 - DNA, 33 bp, homo sapien
agattacaaggtgctaygagaacatgtatgaaa

SEQ ID NO: 7914 - DNA, 33 bp, homo sapien
gaaggccagtgatatasagtagtagaaaacagc

SEQ ID NO: 7915 - DNA, 33 bp, homo sapien
gtaaatcagttttaacsttgctagcctaatgtt

SEQ ID NO: 7916 - DNA, 33 bp, homo sapien
ttaagtgatttgttccrtatagcagagcaagtt

SEQ ID NO: 7917 - DNA, 33 bp, homo sapien
gaagtgggggtacaggyagccatcaatatcttc

SEQ ID NO: 7918 - DNA, 33 bp, homo sapien
ttcagtaagattttcarggcagaatgagacttc

SEQ ID NO: 7919 - DNA, 33 bp, homo sapien
gaaagtgagaagcatgrgaaaagctaggaaaga

SEQ ID NO: 7920 - DNA, 33 bp, homo sapien
tgctacatatgaactayggtataacacgtctga

SEQ ID NO: 7921 - DNA, 33 bp, homo sapien
agtagaaaacgaggtcyattgtggccactgttt

SEQ ID NO: 7922 - DNA, 33 bp, homo sapien
cctctgttaagatgagscaggtttctttctgtc

SEQ ID NO: 7923 - DNA, 33 bp, homo sapien
ggaccaggagggtcatstcagccccaggatcca

SEQ ID NO: 7924 - DNA, 33 bp, homo sapien
gaaaataatttaaatcrtatagcatgccatatt

SEQ ID NO: 7925 - DNA, 33 bp, homo sapien
ctggagtgatgccaccrttgacttcagttgagg

SEQ ID NO: 7926 - DNA, 33 bp, homo sapien
ccttggaatcagccttytctgccacgaattttg

SEQ ID NO: 7927 - DNA, 33 bp, homo sapien
ccttttctgagaattakatagaccacctctatc

SEQ ID NO: 7928 - DNA, 33 bp, homo sapien
tgcatgctgggggaatmgcattacctgaaacaa

SEQ ID NO: 7929 - DNA, 33 bp, homo sapien
ttccggagggagagaaycgctaaaataaaggcc

SEQ ID NO: 7930 - DNA, 33 bp, homo sapien
tgggcaaatacgacaayggctgaggaatgttgc

SEQ ID NO: 7931 - DNA, 33 bp, homo sapien
atgaataacatccaacwgtgtgaaaatacaact

SEQ ID NO: 7932 - DNA, 33 bp, homo sapien
cctacatgttccattgytttttcttagagaaga

SEQ ID NO: 7933 - DNA, 33 bp, homo sapien
tgggctccggcatcctrttttcctggacagact

SEQ ID NO: 7934 - DNA, 33 bp, homo sapien
tgggagtagctgtgggwtctaacaatgaacagt

SEQ ID NO: 7935 - DNA, 33 bp, homo sapien
ttaaaagaaaatctatyccatgctctatctttc

SEQ ID NO: 7936 - DNA, 33 bp, homo sapien
ctgccagaggtaattayacatgttgttttaaat

SEQ ID NO: 7937 - DNA, 33 bp, homo sapien
gagattctgccaaatcrttagctctctcttccc

SEQ ID NO: 7938 - DNA, 33 bp, homo sapien
tatacagactctatgaraaaaaaatatattacc

SEQ ID NO: 7939 - DNA, 33 bp, homo sapien
ttttttattgttggagmgaaaggttacagacaa

SEQ ID NO: 7940 - DNA, 33 bp, homo sapien
ggggtaagcacgatgaycaccttcttacagatg

SEQ ID NO: 7941 - DNA, 33 bp, homo sapien
ttcaaataactgggatygtgcatcacgtcatgg

SEQ ID NO: 7942 - DNA, 33 bp, homo sapien
cctgaggaggaaaacawgaatgatcttacaagt

SEQ ID NO: 7943 - DNA, 33 bp, homo sapien
cagcctacagatggcarttttcacaaagaaagt

SEQ ID NO: 7944 - DNA, 33 bp, homo sapien
gaagattttgtggtgcrtagggcgattgccatc

SEQ ID NO: 7945 - DNA, 33 bp, homo sapien
gggctttcctgaggccrcattcttacagcaaca

SEQ ID NO: 7946 - DNA, 33 bp, homo sapien
cttgactcccaatctcrttatctttccattttg

SEQ ID NO: 7947 - DNA, 33 bp, homo sapien
agtcgtcaaagctgaawgcctgtttgaaccgtg

SEQ ID NO: 7948 - DNA, 33 bp, homo sapien
aggggatgccctgatastaatgggagacaatct

SEQ ID NO: 7949 - DNA, 33 bp, homo sapien
tgcttgcatagagccaygtccagcatcacttaa

SEQ ID NO: 7950 - DNA, 33 bp, homo sapien
tattctctgagtgttayctctctattaatatgt

SEQ ID NO: 7951 - DNA, 33 bp, homo sapien
ttagaatctagcagcckaactgtgcttttcaat

SEQ ID NO: 7952 - DNA, 33 bp, homo sapien
cgcatctagtctatcargctatttactgagtgc

SEQ ID NO: 7953 - DNA, 33 bp, homo sapien
agtacacacgaaaggawaaatgtaaatgatcat

SEQ ID NO: 7954 - DNA, 33 bp, homo sapien
agttagtgctttgtctyctatagtagattattt

SEQ ID NO: 7955 - DNA, 33 bp, homo sapien
ctgagaggtggtataayatctagttagaggtat

SEQ ID NO: 7956 - DNA, 33 bp, homo sapien
ccctatcaccccatacrttttctagttggctat

SEQ ID NO: 7957 - DNA, 33 bp, homo sapien
ggggtagaatgccttcytttgtacttcagtgca

SEQ ID NO: 7958 - DNA, 33 bp, homo sapien
gctcaggactttgctckcattactattacccct

SEQ ID NO: 7959 - DNA, 33 bp, homo sapien
aagcacgtcgtaacccygtctggacgtatttta

SEQ ID NO: 7960 - DNA, 33 bp, homo sapien
cacatcttctgaacttygacttcgcactttgtt

SEQ ID NO: 7961 - DNA, 33 bp, homo sapien
caggaaacttcaataamctatcctgatgggcta

SEQ ID NO: 7962 - DNA, 33 bp, homo sapien
gcagtcttgcactctcraaatgagtgtaggcca

SEQ ID NO: 7963 - DNA, 33 bp, homo sapien
tcaatagccttggcttygtatccccacaatatc

SEQ ID NO: 7964 - DNA, 33 bp, homo sapien
ccctgttcacactagaygtgcctccaccctgaa

SEQ ID NO: 7965 - DNA, 33 bp, homo sapien
cacccacaaatagaaasacctacatagcctata

SEQ ID NO: 7966 - DNA, 33 bp, homo sapien
ggattataatgtttacrgccatctccatgctcc

SEQ ID NO: 7967 - DNA, 33 bp, homo sapien
aatatcatccaaattgytttggctctgcccctc

SEQ ID NO: 7968 - DNA, 33 bp, homo sapien
cataagcaagccaagasagttatctaagttgaa

SEQ ID NO: 7969 - DNA, 33 bp, homo sapien
cccaactgccctcagcrcaaagtgtgtaatggc

SEQ ID NO: 7970 - DNA, 33 bp, homo sapien
taattgccctgaatgtwtcagcacatctaatct

SEQ ID NO: 7971 - DNA, 33 bp, homo sapien
gaggacacctcaaaacrgtggtgaggttgatgt

SEQ ID NO: 7972 - DNA, 33 bp, homo sapien
gtgggcttctgaaaggwaggaaagctttagtca

SEQ ID NO: 7973 - DNA, 33 bp, homo sapien
aacaccacatacttttrtcttttacttctatac

SEQ ID NO: 7974 - DNA, 33 bp, homo sapien
agaatactttaaatacwctctaggcaattataa

SEQ ID NO: 7975 - DNA, 33 bp, homo sapien
cccgcaaaaccatgagmcaattcaaactctttt

SEQ ID NO: 7976 - DNA, 33 bp, homo sapien
attagcaaaaatgctgrgataggaggttgaggc

SEQ ID NO: 7977 - DNA, 33 bp, homo sapien
actaaagaagcttcatytatttctccagctttt

SEQ ID NO: 7978 - DNA, 33 bp, homo sapien
gaaaaactgtttttacrtgaatgaaggcccatt

SEQ ID NO: 7979 - DNA, 33 bp, homo sapien
acagatgatttacaggyttttggcttgagcaat

SEQ ID NO: 7980 - DNA, 33 bp, homo sapien
cagaagctgaccctgaygcaaagattcatgtgc

SEQ ID NO: 7981 - DNA, 33 bp, homo sapien
agagctgggaaccaaasactcctggcaccaagt

SEQ ID NO: 7982 - DNA, 33 bp, homo sapien
cagatgcttcactccartttctacctccatctt

SEQ ID NO: 7983 - DNA, 33 bp, homo sapien
tcaattgggccagaagraagttctagatatttt

SEQ ID NO: 7984 - DNA, 33 bp, homo sapien
ttgtgactgtccttccygaaagcagccctctgt

SEQ ID NO: 7985 - DNA, 33 bp, homo sapien
cctatgtacggtgttcrtcaattcctatggtat

SEQ ID NO: 7986 - DNA, 33 bp, homo sapien
tattgactaaaatcagktggtggaagtgagaca

SEQ ID NO: 7987 - DNA, 33 bp, homo sapien
ttgtagggaagcaaatmccttcaaggttgagtc

SEQ ID NO: 7988 - DNA, 33 bp, homo sapien
tagagaacttaagaaayttgtccaagatataca

SEQ ID NO: 7989 - DNA, 33 bp, homo sapien
ctttgacaaagtttccraaaagtctccagacca

SEQ ID NO: 7990 - DNA, 33 bp, homo sapien
tatgtccaggacctcawtaacacctaatttaga

SEQ ID NO: 7991 - DNA, 33 bp, homo sapien
ggaaaagaatgtataarttgatgtgtttttgta

SEQ ID NO: 7992 - DNA, 33 bp, homo sapien
tatgatgctataacaamagggtcttccatctct

SEQ ID NO: 7993 - DNA, 33 bp, homo sapien
aggaaaaaagattctcraaaatgaagtttcctg

SEQ ID NO: 7994 - DNA, 33 bp, homo sapien
gtgttcaccattatagsttgattatttgttttt

SEQ ID NO: 7995 - DNA, 33 bp, homo sapien
aaggaaacatttgttgrtttggcctattgttga

SEQ ID NO: 7996 - DNA, 33 bp, homo sapien
aaagaaaatacactgtktaagtccccatgtctg

SEQ ID NO: 7997 - DNA, 33 bp, homo sapien
agtgtctcagaatataytgatgaatgcaaatga

SEQ ID NO: 7998 - DNA, 33 bp, homo sapien
gatgagatgaaacaagytgtgcatggcaggaca

SEQ ID NO: 7999 - DNA, 33 bp, homo sapien
ggaatcaagcatacaasgatagaaaactcttaa

SEQ ID NO: 8000 - DNA, 33 bp, homo sapien
aggtcacatttagttgsgttgaactcaaaatct

SEQ ID NO: 8001 - DNA, 33 bp, homo sapien
tccccaaaatattttaygtcctttgcatatggg

SEQ ID NO: 8002 - DNA, 33 bp, homo sapien
ctgattgggtagtcaaygcactttgttaaatta

SEQ ID NO: 8003 - DNA, 33 bp, homo sapien
tactttttatggtaaargcaatgtaggctgata

SEQ ID NO: 8004 - DNA, 33 bp, homo sapien
taggatgtccattactmaaacaaagcagaacaa

SEQ ID NO: 8005 - DNA, 33 bp, homo sapien
aagatagtgaagcagartggtaaaccagctgca

SEQ ID NO: 8006 - DNA, 33 bp, homo sapien
aaatcctgggccttatstcaccaagtttcaggg

SEQ ID NO: 8007 - DNA, 33 bp, homo sapien
tgtgtcttccacattcygttgatggttgaaaca

SEQ ID NO: 8008 - DNA, 33 bp, homo sapien
agcaggggacgaacagytctgcttggcttgcgg

SEQ ID NO: 8009 - DNA, 33 bp, homo sapien
gagagccagtgcgttayatggccagagcaggag

SEQ ID NO: 8010 - DNA, 33 bp, homo sapien
ctatttgagttcaaacrccaacaagaaaacaaa

SEQ ID NO: 8011 - DNA, 33 bp, homo sapien
cttgttgtacagtgcarcagtttcatagcttag

SEQ ID NO: 8012 - DNA, 33 bp, homo sapien
tcatattagtttttagyagtgtcaaaaatggaa

SEQ ID NO: 8013 - DNA, 33 bp, homo sapien
ttcagaagattcttgcmctcaaccatgaactcc

SEQ ID NO: 8014 - DNA, 33 bp, homo sapien
ttcaccatccctagacrtcctgacaagtctgag

SEQ ID NO: 8015 - DNA, 33 bp, homo sapien
gtatgtccattctcagkgctcaaatgccttgct

SEQ ID NO: 8016 - DNA, 33 bp, homo sapien
gagtagtagtggcactytctaaccattagggac

SEQ ID NO: 8017 - DNA, 33 bp, homo sapien
ttaagattgtatctaamcttcaaagtaccatat

SEQ ID NO: 8018 - DNA, 33 bp, homo sapien
aaatggaaagaggtatstaaaatctcccactgt

SEQ ID NO: 8019 - DNA, 33 bp, homo sapien
ggtatcgttcagtcgakgccagtttggacaaag

SEQ ID NO: 8020 - DNA, 33 bp, homo sapien
cccaccgggaggaatgwacaactggagacgcgc

SEQ ID NO: 8021 - DNA, 33 bp, homo sapien
cataaagccaaatattrctcctacatacataac

SEQ ID NO: 8022 - DNA, 33 bp, homo sapien
tggagggccagttgaawaatgtagtgcgtctcc

SEQ ID NO: 8023 - DNA, 33 bp, homo sapien
tgaacctgtaacagccrgaacacagtccatatt

SEQ ID NO: 8024 - DNA, 33 bp, homo sapien
atttcattgtaggaagyggaagtattttaggaa

SEQ ID NO: 8025 - DNA, 33 bp, homo sapien
ggcaccagggataccamcaggaacaagacagat

SEQ ID NO: 8026 - DNA, 33 bp, homo sapien
tttgtcttattatccarttgttttgattttggt

SEQ ID NO: 8027 - DNA, 33 bp, homo sapien
tgtaaccatctaagaaytgtaaatcagaagcaa

SEQ ID NO: 8028 - DNA, 33 bp, homo sapien
atgtgtcttataattcrgctctaacactgtcta

SEQ ID NO: 8029 - DNA, 33 bp, homo sapien
caggtaagtggtacagytatcattagaaaccag

SEQ ID NO: 8030 - DNA, 33 bp, homo sapien
cagccctcctaatttayttcacatttgcatata

SEQ ID NO: 8031 - DNA, 33 bp, homo sapien
tatgccattgtaaagargtagaatttaagtcaa

SEQ ID NO: 8032 - DNA, 33 bp, homo sapien
aagccttgtgaaatcasctttaactgtgtcatc

SEQ ID NO: 8033 - DNA, 33 bp, homo sapien
tgaagttaccaatgttycactggttgacctgcg

SEQ ID NO: 8034 - DNA, 33 bp, homo sapien
aaaactataactccaawgctcatttgattgtgg

SEQ ID NO: 8035 - DNA, 33 bp, homo sapien
ctcctattcatcacggyatctttcattgcagtc

SEQ ID NO: 8036 - DNA, 33 bp, homo sapien
gtctgattattcaaaayttaatgtaggcttata

SEQ ID NO: 8037 - DNA, 33 bp, homo sapien
cactccattagagtgayggaagtgagcattgac

SEQ ID NO: 8038 - DNA, 33 bp, homo sapien
gcatacgtctcaaagcrgttcctcagaatgctt

SEQ ID NO: 8039 - DNA, 33 bp, homo sapien
gaaatataataaagaaygaacatctgcatctgt

SEQ ID NO: 8040 - DNA, 33 bp, homo sapien
cggtcacagcttgtccrcatgatctcctgctcc

SEQ ID NO: 8041 - DNA, 33 bp, homo sapien
taggatcattggatttycatggttttttttgtt

SEQ ID NO: 8042 - DNA, 33 bp, homo sapien
acattttgtcagaaaaygaagtcattactggag

SEQ ID NO: 8043 - DNA, 33 bp, homo sapien
gttggcactatgtgttwattgcttagtacataa

SEQ ID NO: 8044 - DNA, 33 bp, homo sapien
aataaacttgctctcastttatggacttgccct

SEQ ID NO: 8045 - DNA, 33 bp, homo sapien
tgacatgtttcattttrgtaaccttgaactaat

SEQ ID NO: 8046 - DNA, 33 bp, homo sapien
actcctgcttaccgcaygattattttgaggaat

SEQ ID NO: 8047 - DNA, 33 bp, homo sapien
tgacactcctgactgcygggaccgggacctgca

SEQ ID NO: 8048 - DNA, 33 bp, homo sapien
gtctccaacctttttcrcaccaaggaccagttt

SEQ ID NO: 8049 - DNA, 33 bp, homo sapien
cagcgagtttttgcttsagttttgtgttagttt

SEQ ID NO: 8050 - DNA, 33 bp, homo sapien
gggccaaaagggtggakaatgtggatatcatgc

SEQ ID NO: 8051 - DNA, 33 bp, homo sapien
ttatcttttaggatcarttgacccttgagtgag

SEQ ID NO: 8052 - DNA, 33 bp, homo sapien
tattggtgcttgctgcrgaaagttataaggact

SEQ ID NO: 8053 - DNA, 33 bp, homo sapien
ttctcaaaaccacaacraaagtgatgcttttaa

SEQ ID NO: 8054 - DNA, 33 bp, homo sapien
tctattatttcagatasattgtgaagaaaaaat

SEQ ID NO: 8055 - DNA, 33 bp, homo sapien
ataatgaatctaggcawtgatcatcagtgaatg

SEQ ID NO: 8056 - DNA, 33 bp, homo sapien
caattccaacatttaargtatctgtcagttaag

SEQ ID NO: 8057 - DNA, 33 bp, homo sapien
aaaataattctggatgmtcccacaatcatgaat

SEQ ID NO: 8058 - DNA, 33 bp, homo sapien
ttgacctcggagctacygtagttctgtgtttga

SEQ ID NO: 8059 - DNA, 33 bp, homo sapien
aaaagaggtggcagatktgaagtggcccttggt

SEQ ID NO: 8060 - DNA, 33 bp, homo sapien
agtgcatctctaatttkggaaatgatcaatggt

SEQ ID NO: 8061 - DNA, 33 bp, homo sapien
caatcaagttgacaccsgatcactcaatatcaa

SEQ ID NO: 8062 - DNA, 33 bp, homo sapien
agaaaaggaattataaraacagtcatatgttca

SEQ ID NO: 8063 - DNA, 33 bp, homo sapien
accatcaatgggatcartcaagaaccttatcaa

SEQ ID NO: 8064 - DNA, 33 bp, homo sapien
ctatttccaggtccatkttttcagaggccaggt

SEQ ID NO: 8065 - DNA, 33 bp, homo sapien
ggcggtgccggcccatmatattaaataacattg

SEQ ID NO: 8066 - DNA, 33 bp, homo sapien
gccactctttgtacaayaaattacagggtcata

SEQ ID NO: 8067 - DNA, 33 bp, homo sapien
gccctatctgccttctrtaactccatatactca

SEQ ID NO: 8068 - DNA, 33 bp, homo sapien
gtagacgagttaccctktcttcttccatgtacc

SEQ ID NO: 8069 - DNA, 33 bp, homo sapien
cacttcctagcacagcrtttcttcattctactg

SEQ ID NO: 8070 - DNA, 33 bp, homo sapien
tcctcctaatttcaatstaagttagccatttgt

SEQ ID NO: 8071 - DNA, 33 bp, homo sapien
ccatcaaattggttgtyttatttcatctagata

SEQ ID NO: 8072 - DNA, 33 bp, homo sapien
acttttgctttgcatgytgtgtacgcttatgac

SEQ ID NO: 8073 - DNA, 33 bp, homo sapien
tacaaaatgccaggttsatattcaaaataagtt

SEQ ID NO: 8074 - DNA, 33 bp, homo sapien
aagagatctgtggaagrgaactgagaaaaattc

SEQ ID NO: 8075 - DNA, 33 bp, homo sapien
tcccaactctgaatccyatttcatttattgtag

SEQ ID NO: 8076 - DNA, 33 bp, homo sapien
attaagagaagtgaacygatgttctgtttctga

SEQ ID NO: 8077 - DNA, 33 bp, homo sapien
gctattattttatgagygcatgatatctgctag

SEQ ID NO: 8078 - DNA, 33 bp, homo sapien
aatgccttgacgcctcrttgagtttgaactttc

SEQ ID NO: 8079 - DNA, 33 bp, homo sapien
tgcacaatggtatgaawatgtttaacactactg

SEQ ID NO: 8080 - DNA, 33 bp, homo sapien
catcaggaagccattargagattattattggct

SEQ ID NO: 8081 - DNA, 33 bp, homo sapien
cataccttgcagtgaawtataacagtatgacta

SEQ ID NO: 8082 - DNA, 33 bp, homo sapien
cagctttccaagagaawtaagcagtcacactgt

SEQ ID NO: 8083 - DNA, 33 bp, homo sapien
caagaaaaggagtttcwtgagatacaatatagt

SEQ ID NO: 8084 - DNA, 33 bp, homo sapien
cgtacatgttgagattrgaaaggtgagcaccaa

SEQ ID NO: 8085 - DNA, 33 bp, homo sapien
gaattgcagtctaataytcaaaatttcccatga

SEQ ID NO: 8086 - DNA, 33 bp, homo sapien
gtgggacaggtgtaacmagcattgccatatgct

SEQ ID NO: 8087 - DNA, 33 bp, homo sapien
tttatgggtcatctgcsttttctctcctgggac

SEQ ID NO: 8088 - DNA, 33 bp, homo sapien
ctgaggaaactggactwatgagctgtgtgaact

SEQ ID NO: 8089 - DNA, 33 bp, homo sapien
aaacattactaaaaacrggttacaaataggtaa

SEQ ID NO: 8090 - DNA, 33 bp, homo sapien
actccacctcttgatgrgagaagctgtaaagtc

SEQ ID NO: 8091 - DNA, 33 bp, homo sapien
aagttcaagattaggcwtctgcatttggtgagg

SEQ ID NO: 8092 - DNA, 33 bp, homo sapien
agttctgttttcctccktgttctctaacctggt

SEQ ID NO: 8093 - DNA, 33 bp, homo sapien
tttaaaaacatagctcragaactccaacatggc

SEQ ID NO: 8094 - DNA, 33 bp, homo sapien
tttatttttggccttgmtatttttctgtctgaa

SEQ ID NO: 8095 - DNA, 33 bp, homo sapien
gaagaatggctttgatrgtttgatagaaataac

SEQ ID NO: 8096 - DNA, 33 bp, homo sapien
aagtatagtaacagggytcatttggttgcaaag

SEQ ID NO: 8097 - DNA, 33 bp, homo sapien
tgtaatccataagacartgtcaccatagtgacc

SEQ ID NO: 8098 - DNA, 33 bp, homo sapien
ctgacaatcctttccayaaattaccatgcataa

SEQ ID NO: 8099 - DNA, 33 bp, homo sapien
tctcacccatcagtgaygctcttctcttccctg

SEQ ID NO: 8100 - DNA, 33 bp, homo sapien
caatgtcactataagargttgcttttatatggg

SEQ ID NO: 8101 - DNA, 33 bp, homo sapien
acctgtatgtattctgyaaatatttcaaaatct

SEQ ID NO: 8102 - DNA, 33 bp, homo sapien
ggcatccttcccttacmagctgaatgtccctag

SEQ ID NO: 8103 - DNA, 33 bp, homo sapien
attcactgtaacaaaaytgaagggttaggaagc

SEQ ID NO: 8104 - DNA, 33 bp, homo sapien
ttaattcttatctgttyaatgtgactagtagaa

SEQ ID NO: 8105 - DNA, 33 bp, homo sapien
aataccaaaatcttcasttatttatcatattat

SEQ ID NO: 8106 - DNA, 33 bp, homo sapien
taaacattttctaccaygctcccttacccacaa

SEQ ID NO: 8107 - DNA, 33 bp, homo sapien
ctgcaattatttgaacytgtctttttttacaga

SEQ ID NO: 8108 - DNA, 33 bp, homo sapien
agcttgttatgacaggrcacaaaggaggtggct

SEQ ID NO: 8109 - DNA, 33 bp, homo sapien
ctaccatgatcttcccrgagattttttaaacca

SEQ ID NO: 8110 - DNA, 33 bp, homo sapien
aggaatcaatgactaaygaaaaaactaccaaag

SEQ ID NO: 8111 - DNA, 33 bp, homo sapien
ctcttattgctttttcrtgggaatgtagagtat

SEQ ID NO: 8112 - DNA, 33 bp, homo sapien
ttttatcttgaaagtarcaaacttgcttatgat

SEQ ID NO: 8113 - DNA, 33 bp, homo sapien
gcattaatgactttatrgaggcaaaagagtgag

SEQ ID NO: 8114 - DNA, 33 bp, homo sapien
taggagactctgcctcrttgaggatattttgag

SEQ ID NO: 8115 - DNA, 33 bp, homo sapien
tcaagggaaatattaayaggtcttgcatacaca

SEQ ID NO: 8116 - DNA, 33 bp, homo sapien
acctgactctctaaatytgtttgggatttctat

SEQ ID NO: 8117 - DNA, 33 bp, homo sapien
ttagagatgagattagsaaacaaaagtgttaaa

SEQ ID NO: 8118 - DNA, 33 bp, homo sapien
tctggaaggctctgcarctagatctgtgggctc

SEQ ID NO: 8119 - DNA, 33 bp, homo sapien
caattacactggcacamcatacattgcaaatac

SEQ ID NO: 8120 - DNA, 33 bp, homo sapien
gtctgttagtttaaccrtgtatctgactggcca

SEQ ID NO: 8121 - DNA, 33 bp, homo sapien
tgaatggagtcatagakaagaaagatttggagg

SEQ ID NO: 8122 - DNA, 33 bp, homo sapien
atgtaggtgttgaatasttgaagggaacaatca

SEQ ID NO: 8123 - DNA, 33 bp, homo sapien
tctctaaagttttgtckgttcaaactagatgac

SEQ ID NO: 8124 - DNA, 33 bp, homo sapien
cctttctcttggatacmgattgctaagataaac

SEQ ID NO: 8125 - DNA, 33 bp, homo sapien
tctgttgatattgggtragtttctgggcacatt

SEQ ID NO: 8126 - DNA, 33 bp, homo sapien
tcaggacagcaacacawatccattactttgatt

SEQ ID NO: 8127 - DNA, 33 bp, homo sapien
gggccttatactactgyacacctgtgaagccaa

SEQ ID NO: 8128 - DNA, 33 bp, homo sapien
cccaccatacttcctcytattctcttactcccc

SEQ ID NO: 8129 - DNA, 33 bp, homo sapien
ataaatggtatgggtcytagcactgaggaacaa

SEQ ID NO: 8130 - DNA, 33 bp, homo sapien
ccttgtcaagtaccttstcaataacacatgcca

SEQ ID NO: 8131 - DNA, 33 bp, homo sapien
tttttctgaacgtgtayaactgaaagcacatta

SEQ ID NO: 8132 - DNA, 33 bp, homo sapien
caattacagtcagggaytcatatctcattctct

SEQ ID NO: 8133 - DNA, 33 bp, homo sapien
tgcgcatgcctggcaaygttctgggtgctggat

SEQ ID NO: 8134 - DNA, 33 bp, homo sapien
tcaaaagcatctgacarttggcctaacaggaag

SEQ ID NO: 8135 - DNA, 33 bp, homo sapien
tttctcatctacaaaamtaggtaggtagttata

SEQ ID NO: 8136 - DNA, 33 bp, homo sapien
aaaattagcataactgrcagaaatgcagaggca

SEQ ID NO: 8137 - DNA, 33 bp, homo sapien
caggattcatgttcttwtaatggagtggaaagg

SEQ ID NO: 8138 - DNA, 33 bp, homo sapien
tgttcttttctcccgartgatgggatctgtcca

SEQ ID NO: 8139 - DNA, 33 bp, homo sapien
ggttatggcatatgtamaacaggaaagcatttt

SEQ ID NO: 8140 - DNA, 33 bp, homo sapien
acttgcaaaaggcagaytaactggagaacaggt

SEQ ID NO: 8141 - DNA, 33 bp, homo sapien
gtaaaaaaaagccatcygtctggcattgcacaa

SEQ ID NO: 8142 - DNA, 33 bp, homo sapien
gaaatgtttggtgtatytctccgttgtgaagtt

SEQ ID NO: 8143 - DNA, 33 bp, homo sapien
gatttcagccctgatgmatgattttgaagggtt

SEQ ID NO: 8144 - DNA, 33 bp, homo sapien
ttgtaccctcatacacmgctactggggatgtaa

SEQ ID NO: 8145 - DNA, 33 bp, homo sapien
aagctcagtgccagctytgtgacagtgcttgat

SEQ ID NO: 8146 - DNA, 33 bp, homo sapien
tctctcatgctcttgamgttcgtgatgagtact

SEQ ID NO: 8147 - DNA, 33 bp, homo sapien
tctgcaatgatgtatcwgaccattcatgttctc

SEQ ID NO: 8148 - DNA, 33 bp, homo sapien
aatgtagagtcagcctmgtatatgagcatcaga

SEQ ID NO: 8149 - DNA, 33 bp, homo sapien
aagagccagctttcccractcaatcacctctat

SEQ ID NO: 8150 - DNA, 33 bp, homo sapien
aggagagtggaaattakgccagaaagaaaatat

SEQ ID NO: 8151 - DNA, 33 bp, homo sapien
cagtcccaggaaggagrtatgtgagagtgttaa

SEQ ID NO: 8152 - DNA, 33 bp, homo sapien
ctgttctgagcaacccraagctggatgtggaat

SEQ ID NO: 8153 - DNA, 33 bp, homo sapien
ctatttatttaaccttmctaagcctttttaacc

SEQ ID NO: 8154 - DNA, 33 bp, homo sapien
taaatgacattttccaytatgtactccaagttg

SEQ ID NO: 8155 - DNA, 33 bp, homo sapien
gcaagccttcactcacrctcttctgtccaattg

SEQ ID NO: 8156 - DNA, 33 bp, homo sapien
taaaggcatcagtgctrttgtagagttggggca

SEQ ID NO: 8157 - DNA, 33 bp, homo sapien
tccacggtgcttcatayagctctagttaaaata

SEQ ID NO: 8158 - DNA, 33 bp, homo sapien
tcctggttccaattackcctaattatttgttat

SEQ ID NO: 8159 - DNA, 33 bp, homo sapien
ttattaacagtgtttcrataaacataggatgca

SEQ ID NO: 8160 - DNA, 33 bp, homo sapien
aaggaagaagttagaayaactgtacaatagaga

SEQ ID NO: 8161 - DNA, 33 bp, homo sapien
cctaaaatattttcaartgatgtggtattgtct

SEQ ID NO: 8162 - DNA, 33 bp, homo sapien
caccaccattatgattrtgccaggttacaccag

SEQ ID NO: 8163 - DNA, 33 bp, homo sapien
gttatgcttattggtgyacggtagtatgaaatt

SEQ ID NO: 8164 - DNA, 33 bp, homo sapien
cagaacgtagtctatgytggacacttccttctg

SEQ ID NO: 8165 - DNA, 33 bp, homo sapien
ttcttttctctatcacygtaggccctgatatag

SEQ ID NO: 8166 - DNA, 33 bp, homo sapien
aaactctacagaagatkttggaagcttagaggt

SEQ ID NO: 8167 - DNA, 33 bp, homo sapien
gtgtgcatgacagatcrttctctaaccctttac

SEQ ID NO: 8168 - DNA, 33 bp, homo sapien
tctttgagctgtgtttktaagtttcattgtagg

SEQ ID NO: 8169 - DNA, 33 bp, homo sapien
tgtacaactttgagacytgggccactcgggagt

SEQ ID NO: 8170 - DNA, 33 bp, homo sapien
ttgcaattactttgtgwcttccatatgctaagc

SEQ ID NO: 8171 - DNA, 33 bp, homo sapien
gtatgagttagcagtcycagaatgttactggac

SEQ ID NO: 8172 - DNA, 33 bp, homo sapien
aatttggcaattcctawtaaagcaacatagaca

SEQ ID NO: 8173 - DNA, 33 bp, homo sapien
agaaacataaagttcayctcatcatgtagtatg

SEQ ID NO: 8174 - DNA, 33 bp, homo sapien
tagatcaatcataatcmaaaagcatcatctaat

SEQ ID NO: 8175 - DNA, 33 bp, homo sapien
cctttctatagtcaaakaaattaaagcagagaa

SEQ ID NO: 8176 - DNA, 33 bp, homo sapien
attaataaacaggctgygaatctgtgtcttttc

SEQ ID NO: 8177 - DNA, 33 bp, homo sapien
gacccaagaactgcaaraaacagtcaattgtgc

SEQ ID NO: 8178 - DNA, 33 bp, homo sapien
ttgcagctttttcgccyacagcaagaaattcag

SEQ ID NO: 8179 - DNA, 33 bp, homo sapien
ttaaaagctcactgtayaatcaggacgcaaagg

SEQ ID NO: 8180 - DNA, 33 bp, homo sapien
agccacaaagatagacygaggttctggtggcaa

SEQ ID NO: 8181 - DNA, 33 bp, homo sapien
cctaaaagagaacaagrcccaatactacagaaa

SEQ ID NO: 8182 - DNA, 33 bp, homo sapien
cttagcatattaatcayagttgttttaaattcc

SEQ ID NO: 8183 - DNA, 33 bp, homo sapien
aaggcagatagaatcayagcaaccttaggtgac

SEQ ID NO: 8184 - DNA, 33 bp, homo sapien
aagacctgggttcaagycacgactctgctacag

SEQ ID NO: 8185 - DNA, 33 bp, homo sapien
cctgcagaaagttctcrgtagattggtcggggt

SEQ ID NO: 8186 - DNA, 33 bp, homo sapien
ttgcattttcacgggtktaggttttctcatctc

SEQ ID NO: 8187 - DNA, 33 bp, homo sapien
ttttttttttgtacctrgttctatggttacctt

SEQ ID NO: 8188 - DNA, 33 bp, homo sapien
aatggatctgattataygttctgtactgttttc

SEQ ID NO: 8189 - DNA, 33 bp, homo sapien
tagtaatttagatctcwgtaaaaagaaatacca

SEQ ID NO: 8190 - DNA, 33 bp, homo sapien
tcccgaaggacaccacrttgaacccctggccac

SEQ ID NO: 8191 - DNA, 33 bp, homo sapien
aggagattatggcacarcatatggagtccttac

SEQ ID NO: 8192 - DNA, 33 bp, homo sapien
ttggttttgagatgaartggttccacctaagat

SEQ ID NO: 8193 - DNA, 33 bp, homo sapien
ctgaagagaggctcacrtcaagtggaagtcttc

SEQ ID NO: 8194 - DNA, 33 bp, homo sapien
tttcacttagcagagaygaaataccaaaacaga

SEQ ID NO: 8195 - DNA, 33 bp, homo sapien
gagggatgagtcaaagrtgggcagaaatgtcat

SEQ ID NO: 8196 - DNA, 33 bp, homo sapien
aaggtatgctctgccawtttgggatttttagct

SEQ ID NO: 8197 - DNA, 33 bp, homo sapien
gtggctgcttccaagtkgcatatggactagttg

SEQ ID NO: 8198 - DNA, 33 bp, homo sapien
ttagccccgctccagtycttttcattggctcta

SEQ ID NO: 8199 - DNA, 33 bp, homo sapien
acaaacccttgggtgcrgagtagatatggtttc

SEQ ID NO: 8200 - DNA, 33 bp, homo sapien
aaggaatgaatctgtgrgttggttacgtctgga

SEQ ID NO: 8201 - DNA, 33 bp, homo sapien
tagttttgaattaataygaaagaggcaaaattt

SEQ ID NO: 8202 - DNA, 33 bp, homo sapien
tcaagttcttttccctkcctgacatactttggc

SEQ ID NO: 8203 - DNA, 33 bp, homo sapien
cctacagctaatatccwgaaagggtaaaagttg

SEQ ID NO: 8204 - DNA, 33 bp, homo sapien
gatagatagatcatagwtgacagatatgtaaaa

SEQ ID NO: 8205 - DNA, 33 bp, homo sapien
aagtggaattacattasgcaaatgaaaacagca

SEQ ID NO: 8206 - DNA, 33 bp, homo sapien
tgctttggatatttggrttccagtcctttatgt

SEQ ID NO: 8207 - DNA, 33 bp, homo sapien
acatctcagggcacgaygagaagcccataatgg

SEQ ID NO: 8208 - DNA, 33 bp, homo sapien
tgaacaacatcattgcytgggttgcagtcttct

SEQ ID NO: 8209 - DNA, 33 bp, homo sapien
tctcttcatcacaaacrccctagttcaatccac

SEQ ID NO: 8210 - DNA, 33 bp, homo sapien
tatatttatgtcctgcygattgagtatattcat

SEQ ID NO: 8211 - DNA, 33 bp, homo sapien
gttataatgccttcttyggttgacaagttctaa

SEQ ID NO: 8212 - DNA, 33 bp, homo sapien
tgttcacctgaatggcrtggctttccatcactg

SEQ ID NO: 8213 - DNA, 33 bp, homo sapien
tcagggagtaggaaatragagagatagctgtta

SEQ ID NO: 8214 - DNA, 33 bp, homo sapien
tcttctaatatcagttwtaaggactagattaaa

SEQ ID NO: 8215 - DNA, 33 bp, homo sapien
tttgctcggtctacatstgatcctaagggttcc

SEQ ID NO: 8216 - DNA, 33 bp, homo sapien
tttagctagcagaggaytcaatgatgcaagata

SEQ ID NO: 8217 - DNA, 33 bp, homo sapien
ttctgaaaaaccaactktttgcttcactgattc

SEQ ID NO: 8218 - DNA, 33 bp, homo sapien
aagaattgatggataamtttttctcagaagatg

SEQ ID NO: 8219 - DNA, 33 bp, homo sapien
tgctttatcttgcatgracttttgtaactgcct

SEQ ID NO: 8220 - DNA, 33 bp, homo sapien
atatccattcacagatyctaccacaacagtgtt

SEQ ID NO: 8221 - DNA, 33 bp, homo sapien
ctgagagatttttatgygtggattctttttatc

SEQ ID NO: 8222 - DNA, 33 bp, homo sapien
atctttatcccaagtcytctgactcgtccttct

SEQ ID NO: 8223 - DNA, 33 bp, homo sapien
atccctagctctgtctytatcatctctatctct

SEQ ID NO: 8224 - DNA, 33 bp, homo sapien
atttttaaatatttcaygtaaaccatagactga

SEQ ID NO: 8225 - DNA, 33 bp, homo sapien
aaggtcaaacttttccrtagcagctgtgcccat

SEQ ID NO: 8226 - DNA, 33 bp, homo sapien
tcgtataggagagccaytatgtaggtgagggcc

SEQ ID NO: 8227 - DNA, 33 bp, homo sapien
acatgcacataaaaaamattcaacaccactgac

SEQ ID NO: 8228 - DNA, 33 bp, homo sapien
cttctggggcagtccakgtgtggagctcttgtc

SEQ ID NO: 8229 - DNA, 33 bp, homo sapien
aagcagttatgtttctyggaagcagtttaatct

SEQ ID NO: 8230 - DNA, 33 bp, homo sapien
cagtggaggtcagacgycaagtagaaaacctgg

SEQ ID NO: 8231 - DNA, 33 bp, homo sapien
ggcctagagagattaarttgcttgtccaagttc

SEQ ID NO: 8232 - DNA, 33 bp, homo sapien
ttcatactttcatagamtagaacaggacagaat

SEQ ID NO: 8233 - DNA, 33 bp, homo sapien
tacataagtgaattagmagttttagagcatgtt

SEQ ID NO: 8234 - DNA, 33 bp, homo sapien
tccatctagtgctatgragtatttcctaggtac

SEQ ID NO: 8235 - DNA, 33 bp, homo sapien
gacaatcttttaccagmactttgaatactaaat

SEQ ID NO: 8236 - DNA, 33 bp, homo sapien
ctttttttgtggtcttyagtaagttgtatgttg

SEQ ID NO: 8237 - DNA, 33 bp, homo sapien
cattaaatctaagctartgctatctcgctccat

SEQ ID NO: 8238 - DNA, 33 bp, homo sapien
ctactgtgtacattttsatagcttatcttttct

SEQ ID NO: 8239 - DNA, 33 bp, homo sapien
atgttcttctttgttcytttctaccattactgg

SEQ ID NO: 8240 - DNA, 33 bp, homo sapien
gaaaaataaagagctgmtttctgaaacataacc

SEQ ID NO: 8241 - DNA, 33 bp, homo sapien
aaggcataaagtgatcygggtgatggagggcag

SEQ ID NO: 8242 - DNA, 33 bp, homo sapien
cagacctttgaagttayggctcttcttgcttct

SEQ ID NO: 8243 - DNA, 33 bp, homo sapien
gttttggacttgcacgrgacctgtatcctctcc

SEQ ID NO: 8244 - DNA, 33 bp, homo sapien
ggcttccgatcacttayctgtttgttctgactc

SEQ ID NO: 8245 - DNA, 33 bp, homo sapien
aacacagtgactcataktagatcatttgtaaca

SEQ ID NO: 8246 - DNA, 33 bp, homo sapien
ttaagcctcacatcctraaaacggtactggtgc

SEQ ID NO: 8247 - DNA, 33 bp, homo sapien
catcacgatacttatckcgtttccatcataact

SEQ ID NO: 8248 - DNA, 33 bp, homo sapien
ctcattactcatgaagmcagatgggaagtggag

SEQ ID NO: 8249 - DNA, 33 bp, homo sapien
tttccacttagctgaawccaccatatagagaaa

SEQ ID NO: 8250 - DNA, 33 bp, homo sapien
actgtaaaagtcaaaartttaccatcctggcta

SEQ ID NO: 8251 - DNA, 33 bp, homo sapien
accacatctaaaattgyatttattgtgtgcaac

SEQ ID NO: 8252 - DNA, 33 bp, homo sapien
ccccctggctgacgtgktgcccatcaggacctg

SEQ ID NO: 8253 - DNA, 33 bp, homo sapien
cttttggaggtcttctytggaattatatcaaaa

SEQ ID NO: 8254 - DNA, 33 bp, homo sapien
tgaaagatctgatgaarcccagcgtgtttttaa

SEQ ID NO: 8255 - DNA, 33 bp, homo sapien
aggaggcagaactcagrcactagtgcaagaatg

SEQ ID NO: 8256 - DNA, 33 bp, homo sapien
agatacagctttgatcraaacactcaaatcctt

SEQ ID NO: 8257 - DNA, 33 bp, homo sapien
cgcttatattatcatcsgagccataactggaat

SEQ ID NO: 8258 - DNA, 33 bp, homo sapien
attatgaatgagcaaasataaaaaagaaatctc

SEQ ID NO: 8259 - DNA, 33 bp, homo sapien
aagtgaggcttagagarctaaagtaacttgttt

SEQ ID NO: 8260 - DNA, 33 bp, homo sapien
aaaaagacattctaaarggcagtttatttttct

SEQ ID NO: 8261 - DNA, 33 bp, homo sapien
cattaatatcgttatcyatgactgcttttaaca

SEQ ID NO: 8262 - DNA, 33 bp, homo sapien
gcaaagatctctagcartctttccctcttacct

SEQ ID NO: 8263 - DNA, 33 bp, homo sapien
atgagcatggaactttkgtcaaaccaaaaagga

SEQ ID NO: 8264 - DNA, 33 bp, homo sapien
tgagtcatatcaagaarggagaagcccaagcaa

SEQ ID NO: 8265 - DNA, 33 bp, homo sapien
catgggtttcagttaayggcaactttagagaca

SEQ ID NO: 8266 - DNA, 33 bp, homo sapien
caattaaggctaatacstataataacatttctc

SEQ ID NO: 8267 - DNA, 33 bp, homo sapien
cctacttctccaacacygtgctctctagcttcc

SEQ ID NO: 8268 - DNA, 33 bp, homo sapien
aagagttgcagcttctrggagctcagcaggaag

SEQ ID NO: 8269 - DNA, 33 bp, homo sapien
ggcttcccattagatcytgacctgcctcgctgg

SEQ ID NO: 8270 - DNA, 33 bp, homo sapien
ggaaagtggttggttcmaggtcacaccatgagc

SEQ ID NO: 8271 - DNA, 33 bp, homo sapien
tcttcagaggctattaygaacagcactatccac

SEQ ID NO: 8272 - DNA, 33 bp, homo sapien
gagagattttattggaraggaaagaaaagaact

SEQ ID NO: 8273 - DNA, 33 bp, homo sapien
tctattaattgcagctkaacttaaacccaatta

SEQ ID NO: 8274 - DNA, 33 bp, homo sapien
ttaccagaaggtagagrttcagttgctgggtgt

SEQ ID NO: 8275 - DNA, 33 bp, homo sapien
actgaagtgactttcawactagggtgaggctag

SEQ ID NO: 8276 - DNA, 33 bp, homo sapien
ggagtcctggaaatagrttcttggagacacagc

SEQ ID NO: 8277 - DNA, 33 bp, homo sapien
cttttgaggttaagaaygagtaataagaccttg

SEQ ID NO: 8278 - DNA, 33 bp, homo sapien
cacaagttgctattgawacctccaattctaatt

SEQ ID NO: 8279 - DNA, 33 bp, homo sapien
gttgtggagttgaagawagggagtttcccaccc

SEQ ID NO: 8280 - DNA, 33 bp, homo sapien
ctactcactctgtttcwtcctagtttttttcct

SEQ ID NO: 8281 - DNA, 33 bp, homo sapien
tgattactttgggacaytgttctttccacctaa

SEQ ID NO: 8282 - DNA, 33 bp, homo sapien
caagtatctctgcttcytccctagcagttgcat

SEQ ID NO: 8283 - DNA, 33 bp, homo sapien
ttatacctatcgataartatgtgtgtggaggta

SEQ ID NO: 8284 - DNA, 33 bp, homo sapien
agagtatgtcaagtacrgggctgcaaaaaacca

SEQ ID NO: 8285 - DNA, 33 bp, homo sapien
gttagctgttcctttgyttggctacgtccatgt

SEQ ID NO: 8286 - DNA, 33 bp, homo sapien
tttgaaaggtgcataayggactcccttctctgg

SEQ ID NO: 8287 - DNA, 33 bp, homo sapien
agaatatgccagatcaytgaaggcagatatctt

SEQ ID NO: 8288 - DNA, 33 bp, homo sapien
atgacagaaatttgggkaagttgataaaagaat

SEQ ID NO: 8289 - DNA, 33 bp, homo sapien
atgaccctggtgctgtrtgatcctgggcaagtg

SEQ ID NO: 8290 - DNA, 33 bp, homo sapien
agtaaaacagttgtgcrttaaatagttacttgc

SEQ ID NO: 8291 - DNA, 33 bp, homo sapien
cactatagtgaatgtgktagcttctggaaactg

SEQ ID NO: 8292 - DNA, 33 bp, homo sapien
aattcttgatactagcrgtagaggattcagaag

SEQ ID NO: 8293 - DNA, 33 bp, homo sapien
gtccagggtaagccacraggcattgtcatctca

SEQ ID NO: 8294 - DNA, 33 bp, homo sapien
tgatccaacaatcttcrtttgggagtatcagga

SEQ ID NO: 8295 - DNA, 33 bp, homo sapien
aaaagcattcaatatcrttgttcatcattcaaa

SEQ ID NO: 8296 - DNA, 33 bp, homo sapien
aggggcgaaggcagacytgccagaagcacaggc

SEQ ID NO: 8297 - DNA, 33 bp, homo sapien
ttgtttgtttgaaatgycagatatagcaaaaaa

SEQ ID NO: 8298 - DNA, 33 bp, homo sapien
aaagagccatttatttsttgcattgttatgttt

SEQ ID NO: 8299 - DNA, 33 bp, homo sapien
attaatttcttccactrcaagacactagagctt

SEQ ID NO: 8300 - DNA, 33 bp, homo sapien
accctgattgagtaaayatggcaaagaacagct

SEQ ID NO: 8301 - DNA, 33 bp, homo sapien
ctttcaacaaatcaaayggtttattcctagttc

SEQ ID NO: 8302 - DNA, 33 bp, homo sapien
gttaaatggtgttggayttacataagagaaata

SEQ ID NO: 8303 - DNA, 33 bp, homo sapien
caaaacatcacatactstctgcgatggctaatt

SEQ ID NO: 8304 - DNA, 33 bp, homo sapien
gtgacttcccagacackatgtggcaagagttgc

SEQ ID NO: 8305 - DNA, 33 bp, homo sapien
cagcagtctctaaatarcttcaccagaacccaa

SEQ ID NO: 8306 - DNA, 33 bp, homo sapien
atgctgttaccagaagraagttatgtagagtgg

SEQ ID NO: 8307 - DNA, 33 bp, homo sapien
accccacatgtcttcgytgtgcagataaggaac

SEQ ID NO: 8308 - DNA, 33 bp, homo sapien
taaaaacagaggtatcrgactatataaaaatca

SEQ ID NO: 8309 - DNA, 33 bp, homo sapien
tttgagattctgattgyggttcttttgaataaa

SEQ ID NO: 8310 - DNA, 33 bp, homo sapien
cataactgtctaaaacrtaagtgctattttaag

SEQ ID NO: 8311 - DNA, 33 bp, homo sapien
ctattatttcatcagtycctgttagctctatgg

SEQ ID NO: 8312 - DNA, 33 bp, homo sapien
gatggtgaaatcctgakttgactaagagcacat

SEQ ID NO: 8313 - DNA, 33 bp, homo sapien
aaacattatatgttacwgtcaaatcctctgcta

SEQ ID NO: 8314 - DNA, 33 bp, homo sapien
tggtgccccactgaatyttgtgtacctgtgact

SEQ ID NO: 8315 - DNA, 33 bp, homo sapien
aaaaaaatagaaacgamctaataactaagtgat

SEQ ID NO: 8316 - DNA, 33 bp, homo sapien
gcacttgagacactcgrgattcggggatggcag

SEQ ID NO: 8317 - DNA, 33 bp, homo sapien
cctctgtggctcatctrtagtgctgcttttgag

SEQ ID NO: 8318 - DNA, 33 bp, homo sapien
tttctgcctctgatgcmttaccatatagaatcc

SEQ ID NO: 8319 - DNA, 33 bp, homo sapien
gtaaggagagaacttcygactgaaagctagaga

SEQ ID NO: 8320 - DNA, 33 bp, homo sapien
ttcagacaagtaaacasatgagtataaggcatg

SEQ ID NO: 8321 - DNA, 33 bp, homo sapien
tcagctttggtgcaatyaaaggaatgtgaaata

SEQ ID NO: 8322 - DNA, 33 bp, homo sapien
ccaaataaattcctgcrtaacaagtaccaatgg

SEQ ID NO: 8323 - DNA, 33 bp, homo sapien
catttactgcacttagytacacattaagggctc

SEQ ID NO: 8324 - DNA, 33 bp, homo sapien
agccaggagattaacaytgatgcaataccatta

SEQ ID NO: 8325 - DNA, 33 bp, homo sapien
agcctcggtcatgaaasagcccaaggcaggcag

SEQ ID NO: 8326 - DNA, 33 bp, homo sapien
attcttctgaagatgamtcctatgttttcagtc

SEQ ID NO: 8327 - DNA, 33 bp, homo sapien
tattataggagacatcwcaggaggaaaacgcag

SEQ ID NO: 8328 - DNA, 33 bp, homo sapien
atgaactatagtgggaycaaagagagagaataa

SEQ ID NO: 8329 - DNA, 33 bp, homo sapien
ctctttcagctctttcrttactgtcttttatgt

SEQ ID NO: 8330 - DNA, 33 bp, homo sapien
gactctttatgcatctktcatctcttgctttcc

SEQ ID NO: 8331 - DNA, 33 bp, homo sapien
gacaactgggaggttcygattttgttgtctggg

SEQ ID NO: 8332 - DNA, 33 bp, homo sapien
gatgtaaaaacctcagrtctccttcacgccact

SEQ ID NO: 8333 - DNA, 33 bp, homo sapien
tgttcttctgcagaacygttttctccttgatca

SEQ ID NO: 8334 - DNA, 33 bp, homo sapien
atcccacacatctcttyattgtgcttgtgattt

SEQ ID NO: 8335 - DNA, 33 bp, homo sapien
cccaggattagtctccrtggctgattcactaca

SEQ ID NO: 8336 - DNA, 33 bp, homo sapien
atgatggaaatgttcgytgtctgcactgtctga

SEQ ID NO: 8337 - DNA, 33 bp, homo sapien
tagaaaattttgcccaratgttatcagtaggtg

SEQ ID NO: 8338 - DNA, 33 bp, homo sapien
taaacactgaattaccrtatgtcccagcaattc

SEQ ID NO: 8339 - DNA, 33 bp, homo sapien
tctgtattctcattgtkaattctgggacccagg

SEQ ID NO: 8340 - DNA, 33 bp, homo sapien
gggacatagcaagggaytcctactgcttgagga

SEQ ID NO: 8341 - DNA, 33 bp, homo sapien
tggatcgagatgatatyttgattttcaagtctt

SEQ ID NO: 8342 - DNA, 33 bp, homo sapien
ctttataagaagagaaratccatagacacccag

SEQ ID NO: 8343 - DNA, 33 bp, homo sapien
gaactatggatacctgkgttctaatcttaacag

SEQ ID NO: 8344 - DNA, 33 bp, homo sapien
agacagcagggacatgsctctcagcttcatttc

SEQ ID NO: 8345 - DNA, 33 bp, homo sapien
ttcttgagtaatagtgrcaagctaataaaaaac

SEQ ID NO: 8346 - DNA, 33 bp, homo sapien
cttaggtttagttgttsaacatcatctcagact

SEQ ID NO: 8347 - DNA, 33 bp, homo sapien
ccaactttttctgataycacaccctggtcttca

SEQ ID NO: 8348 - DNA, 33 bp, homo sapien
tgacatatccatgaatwtaatgctacaatatat

SEQ ID NO: 8349 - DNA, 33 bp, homo sapien
gaggctgaccctgcctstcttatattcttactc

SEQ ID NO: 8350 - DNA, 33 bp, homo sapien
actccaccttttgtggmaggaaggactattcaa

SEQ ID NO: 8351 - DNA, 33 bp, homo sapien
gtcaaagggaggttgaygaaatattatgcaact

SEQ ID NO: 8352 - DNA, 33 bp, homo sapien
tggtattaggtacaaawccataatgactgattc

SEQ ID NO: 8353 - DNA, 33 bp, homo sapien
agttgatatttcagttraggttctcttggcaca

SEQ ID NO: 8354 - DNA, 33 bp, homo sapien
cacatttccaaaatagstgcctaaaatgaagat

SEQ ID NO: 8355 - DNA, 33 bp, homo sapien
taaataacacgacagargacaagtatgaatgtg

SEQ ID NO: 8356 - DNA, 33 bp, homo sapien
tagaatagataagttcmgaatagtcacaatttc

SEQ ID NO: 8357 - DNA, 33 bp, homo sapien
ttccaaagcaccctatwccaaagctctctcccc

SEQ ID NO: 8358 - DNA, 33 bp, homo sapien
aacaggtcagccacaawttagtcattaatatgt

SEQ ID NO: 8359 - DNA, 33 bp, homo sapien
attcaggtttgccatastggagcaagtagtgtt

SEQ ID NO: 8360 - DNA, 33 bp, homo sapien
tattctttatgtaaaayggtaggatgctaggag

SEQ ID NO: 8361 - DNA, 33 bp, homo sapien
agtataagaactgtggraaaattatttcattgc

SEQ ID NO: 8362 - DNA, 33 bp, homo sapien
tcacctaattctcgtcrggccagtcacttccat

SEQ ID NO: 8363 - DNA, 33 bp, homo sapien
cacctaaacattcaaarccaagatgctggctag

SEQ ID NO: 8364 - DNA, 33 bp, homo sapien
acagaaataatgcacaytccataatctcaaaca

SEQ ID NO: 8365 - DNA, 33 bp, homo sapien
aggagagcttacggctycaaagccaagggggac

SEQ ID NO: 8366 - DNA, 33 bp, homo sapien
tttgctgaggacaagayatgttgacaaacccag

SEQ ID NO: 8367 - DNA, 33 bp, homo sapien
tcaggcttctctatgtkctcaaatgaatctgac

SEQ ID NO: 8368 - DNA, 33 bp, homo sapien
ggcttatagagcttaaygaaggaatagaaatca

SEQ ID NO: 8369 - DNA, 33 bp, homo sapien
atcaaattcacatgcarggatggctcttgaagg

SEQ ID NO: 8370 - DNA, 33 bp, homo sapien
ttcacgctgattattcwtcctacgttgtatacc

SEQ ID NO: 8371 - DNA, 33 bp, homo sapien
catcactatccttggcragagttcactgcagat

SEQ ID NO: 8372 - DNA, 33 bp, homo sapien
tggtcatagaggtggasaatcataaaattgtca

SEQ ID NO: 8373 - DNA, 33 bp, homo sapien
atgtaatgtcaacttayaaacctctcataataa

SEQ ID NO: 8374 - DNA, 33 bp, homo sapien
tcataggcaggaaaatmgataacattacaatga

SEQ ID NO: 8375 - DNA, 33 bp, homo sapien
tgaggtatttgtccctyggaacagagcacagtt

SEQ ID NO: 8376 - DNA, 33 bp, homo sapien
attgatttctacagcayaacctagcatatcctg

SEQ ID NO: 8377 - DNA, 33 bp, homo sapien
aaacattaataagtggrtgtcctcatttatcca

SEQ ID NO: 8378 - DNA, 33 bp, homo sapien
aaattgttttccacagyggctatgctgttttta

SEQ ID NO: 8379 - DNA, 33 bp, homo sapien
aaacatacattatgaamcacaggcttctaatga

SEQ ID NO: 8380 - DNA, 33 bp, homo sapien
cagaactatccaaagawggcataagttgtttca

SEQ ID NO: 8381 - DNA, 33 bp, homo sapien
atattgacacctatatyatccagacaattctag

SEQ ID NO: 8382 - DNA, 33 bp, homo sapien
caaaagagtagaggttmgtggaattgttttttc

SEQ ID NO: 8383 - DNA, 33 bp, homo sapien
agttgctgctcaatgayacctgcagacactgag

SEQ ID NO: 8384 - DNA, 33 bp, homo sapien
ccttatgcatttcacakcctcttctcaaggact

SEQ ID NO: 8385 - DNA, 33 bp, homo sapien
atggctagatgggtccraaagcatgcagttcat

SEQ ID NO: 8386 - DNA, 33 bp, homo sapien
atatgttgcctagagcycgatgctatccaagat

SEQ ID NO: 8387 - DNA, 33 bp, homo sapien
cccagcaagcagtcttyctgcaatggtgctgtc

SEQ ID NO: 8388 - DNA, 33 bp, homo sapien
acttgtggatgtagaasctgtggatgcagaggg

SEQ ID NO: 8389 - DNA, 33 bp, homo sapien
aaaaccagttagcaccratcttgtacatattta

SEQ ID NO: 8390 - DNA, 33 bp, homo sapien
tgtattcataaatcatwgcatcacattgtactc

SEQ ID NO: 8391 - DNA, 33 bp, homo sapien
tatcgccttgatttacyaggaaattacaggaaa

SEQ ID NO: 8392 - DNA, 33 bp, homo sapien
tcaattcttttgtgcaygaggcattttaaactt

SEQ ID NO: 8393 - DNA, 33 bp, homo sapien
cctcatagtttgctcaragattgtagtttactc

SEQ ID NO: 8394 - DNA, 33 bp, homo sapien
ttggaaaatctggatartctccccatcacatga

SEQ ID NO: 8395 - DNA, 33 bp, homo sapien
tcccaggaaagagccasatgttcagtgagacta

SEQ ID NO: 8396 - DNA, 33 bp, homo sapien
tctgactctgacaggtmcttaaaaccaagtgaa

SEQ ID NO: 8397 - DNA, 33 bp, homo sapien
ccttgatcaacgtaatrgtaaaaattcttaaca

SEQ ID NO: 8398 - DNA, 33 bp, homo sapien
aaaagagccctgacgtrcatacttgtgttctct

SEQ ID NO: 8399 - DNA, 33 bp, homo sapien
ttcattaaaatttagcygagaacttctagaatt

SEQ ID NO: 8400 - DNA, 33 bp, homo sapien
ggaagaaggaagcaatktgagttgaaaaaagat

SEQ ID NO: 8401 - DNA, 33 bp, homo sapien
ctgtagaagctgtgtgytaaacctaacacatgc

SEQ ID NO: 8402 - DNA, 33 bp, homo sapien
aaatcagtttattttcyttctattgaattgttt

SEQ ID NO: 8403 - DNA, 33 bp, homo sapien
cataatgataactcccwtttttggagcccttga

SEQ ID NO: 8404 - DNA, 33 bp, homo sapien
ccaggatctgacttacytaggtgattttattta

SEQ ID NO: 8405 - DNA, 33 bp, homo sapien
caccaaatcatgagttycttgagtgtgagaaat

SEQ ID NO: 8406 - DNA, 33 bp, homo sapien
aagtagcttaactgtaygccaggagaaaaaaaa

SEQ ID NO: 8407 - DNA, 33 bp, homo sapien
gaggtttaatatatgastgctgactttgcctag

SEQ ID NO: 8408 - DNA, 33 bp, homo sapien
cagccttcactcaacaktagtttttgtttcatg

SEQ ID NO: 8409 - DNA, 33 bp, homo sapien
ttgggggttaaggcttsaacatatgaaattggg

SEQ ID NO: 8410 - DNA, 33 bp, homo sapien
ctttcctgctccaggargtatatcagaatgcaa

SEQ ID NO: 8411 - DNA, 33 bp, homo sapien
tccaacgagcctacaayatcttgttctaccagc

SEQ ID NO: 8412 - DNA, 33 bp, homo sapien
atttgaatatatgatayaatgatggcacatatt

SEQ ID NO: 8413 - DNA, 33 bp, homo sapien
gcccatatttaatgtakgcaatttgatgagttt

SEQ ID NO: 8414 - DNA, 33 bp, homo sapien
tcttgatttaattttcyacttgtgcaaatcata

SEQ ID NO: 8415 - DNA, 33 bp, homo sapien
caagaaggatgttttcrttttcagtttttactt

SEQ ID NO: 8416 - DNA, 33 bp, homo sapien
aaatgtgagccagaagrtttttaatgggagaaa

SEQ ID NO: 8417 - DNA, 33 bp, homo sapien
aggtcaaagcaccgtawcttggggtattggttt

SEQ ID NO: 8418 - DNA, 33 bp, homo sapien
tttggtgaactggtggmcctacaagtaagtaat

SEQ ID NO: 8419 - DNA, 33 bp, homo sapien
atggtacttaggcattrggactttaaaaaataa

SEQ ID NO: 8420 - DNA, 33 bp, homo sapien
caaataccgtttcattkcctccgatttataatg

SEQ ID NO: 8421 - DNA, 33 bp, homo sapien
ggaaaagcccaatttarctatggaagggaccac

SEQ ID NO: 8422 - DNA, 33 bp, homo sapien
atctaaaaatttgaaarctcctcatttgtgaaa

SEQ ID NO: 8423 - DNA, 33 bp, homo sapien
gaacaagaaagaagcamcatggtagacatcatg

SEQ ID NO: 8424 - DNA, 33 bp, homo sapien
ggtactacttgactttyaacattatacacatga

SEQ ID NO: 8425 - DNA, 33 bp, homo sapien
tctatcaggaaagtaayacaagtagtgctatta

SEQ ID NO: 8426 - DNA, 33 bp, homo sapien
aacagtattagattgaytaaaagcatggtgcat

SEQ ID NO: 8427 - DNA, 33 bp, homo sapien
ttagagaatatgggtgytagacatttgacttga

SEQ ID NO: 8428 - DNA, 33 bp, homo sapien
cttccttaggaaactgsatagattaatgcacaa

SEQ ID NO: 8429 - DNA, 33 bp, homo sapien
ggattgtagaaaccacrgagtgacaggtgagtg

SEQ ID NO: 8430 - DNA, 33 bp, homo sapien
gtaagggtttgagaagraatatgtcggcttaaa

SEQ ID NO: 8431 - DNA, 33 bp, homo sapien
attcctggacaaagacwtggagttaggaatagc

SEQ ID NO: 8432 - DNA, 33 bp, homo sapien
tgtgggagaagcacaayagatgagcagaaatta

SEQ ID NO: 8433 - DNA, 33 bp, homo sapien
aatattacaagaactaytgtattttctgcgtat

SEQ ID NO: 8434 - DNA, 33 bp, homo sapien
ctttgctggaagttttrtaagaaatcagattga

SEQ ID NO: 8435 - DNA, 33 bp, homo sapien
aactttaaggaatggcygatgcccagtcattat

SEQ ID NO: 8436 - DNA, 33 bp, homo sapien
atgtgcttaaaggagtyaaaacattgatctcac

SEQ ID NO: 8437 - DNA, 33 bp, homo sapien
tcaactgattgtaaacrttaatgccatccacaa

SEQ ID NO: 8438 - DNA, 33 bp, homo sapien
tgcaatttccttatttstctcagccttcatgga

SEQ ID NO: 8439 - DNA, 33 bp, homo sapien
atataactgcattcgaktcaacacattcttctt

SEQ ID NO: 8440 - DNA, 33 bp, homo sapien
tttttctctttgtttcytttttagacataccag

SEQ ID NO: 8441 - DNA, 33 bp, homo sapien
actggcgagctggtgtrgagttgaccttcattg

SEQ ID NO: 8442 - DNA, 33 bp, homo sapien
ttgacaaagcaagacaratgacctggaaattaa

SEQ ID NO: 8443 - DNA, 33 bp, homo sapien
tagagctctggaaacgrttactagttagtattg

SEQ ID NO: 8444 - DNA, 33 bp, homo sapien
tacattctaggaaccartaatcagcacactcgg

SEQ ID NO: 8445 - DNA, 33 bp, homo sapien
aaaaaaggttatatgaygatttgcagactggct

SEQ ID NO: 8446 - DNA, 33 bp, homo sapien
tgtatagttctgagatrtcaatgcaattaatgt

SEQ ID NO: 8447 - DNA, 33 bp, homo sapien
gtgtaattgccactttyatggactagtgcattt

SEQ ID NO: 8448 - DNA, 33 bp, homo sapien
ctggttggttgctcctratttgagtggacaaag

SEQ ID NO: 8449 - DNA, 33 bp, homo sapien
aaaatagaatagcaatwaaacctacttctttgg

SEQ ID NO: 8450 - DNA, 33 bp, homo sapien
aacacattacgtggcgrtcccaattcagaatgg

SEQ ID NO: 8451 - DNA, 33 bp, homo sapien
aataatgtaagctctayaaaggcaggtggctct

SEQ ID NO: 8452 - DNA, 33 bp, homo sapien
tgtaactagccagcggmcaaatggcagatgact

SEQ ID NO: 8453 - DNA, 33 bp, homo sapien
ctattttaccccgtggygtgctatgttgtcttt

SEQ ID NO: 8454 - DNA, 33 bp, homo sapien
ctgatgagctgctcagwtgtcatacattttctg

SEQ ID NO: 8455 - DNA, 33 bp, homo sapien
gataaacttacaaatgytaccagtgtggattac

SEQ ID NO: 8456 - DNA, 33 bp, homo sapien
aaagccatggaaataayggccagcataggtgaa

SEQ ID NO: 8457 - DNA, 33 bp, homo sapien
gtggtaatgcccattcytggttcatgagagtca

SEQ ID NO: 8458 - DNA, 33 bp, homo sapien
gctttctcactttgtgycactctgatgctaact

SEQ ID NO: 8459 - DNA, 33 bp, homo sapien
ataagcattgatttctsgcactgagtctaacag

SEQ ID NO: 8460 - DNA, 33 bp, homo sapien
ctgttggcataagagtytcagtctggatattgg

SEQ ID NO: 8461 - DNA, 33 bp, homo sapien
tagccactggacaatckaacaatgtgatttgtg

SEQ ID NO: 8462 - DNA, 33 bp, homo sapien
ggtacaagttcttggcsttctgtgtgctgggtc

SEQ ID NO: 8463 - DNA, 33 bp, homo sapien
aggacctttcaccttgwctatatggcattatgt

SEQ ID NO: 8464 - DNA, 33 bp, homo sapien
gatgaggcaaggaatgycactcatacatgggga

SEQ ID NO: 8465 - DNA, 33 bp, homo sapien
tagtttctagtagactygagctgctgtgggggt

SEQ ID NO: 8466 - DNA, 33 bp, homo sapien
ctcatactttagcccawaaagaaagccattagg

SEQ ID NO: 8467 - DNA, 33 bp, homo sapien
aaagacaacttttccayggactgaggttgggga

SEQ ID NO: 8468 - DNA, 33 bp, homo sapien
taagaaagtcctatctkctttaatctttacaag

SEQ ID NO: 8469 - DNA, 33 bp, homo sapien
tgctcagaagctaatcrtaaagtggacccagct

SEQ ID NO: 8470 - DNA, 33 bp, homo sapien
aagtccagtttatccargtccaagaagtagtaa

SEQ ID NO: 8471 - DNA, 33 bp, homo sapien
gtctggtaacagcttcyttctggaccgggatgg

SEQ ID NO: 8472 - DNA, 33 bp, homo sapien
atctctcctcaccgcargcttcacctcccgggt

SEQ ID NO: 8473 - DNA, 33 bp, homo sapien
gcaataaacaggcaagrcagggagattagggga

SEQ ID NO: 8474 - DNA, 33 bp, homo sapien
gtaaagttattctcgtkttctccatttccattt

SEQ ID NO: 8475 - DNA, 33 bp, homo sapien
atacaatgtttcagtgmgtacacagtcaacacc

SEQ ID NO: 8476 - DNA, 33 bp, homo sapien
tttctttgatatcatgytggcattaactaggct

SEQ ID NO: 8477 - DNA, 33 bp, homo sapien
atcggatggtctagcaycttttttgaattatga

SEQ ID NO: 8478 - DNA, 33 bp, homo sapien
agtctattttctcatgsctaagtgacagtgcta

SEQ ID NO: 8479 - DNA, 33 bp, homo sapien
ggctgttttgtctacaytgacaatctgttgttt

SEQ ID NO: 8480 - DNA, 33 bp, homo sapien
cacatcagtaacctcasggccacttagcaacta

SEQ ID NO: 8481 - DNA, 33 bp, homo sapien
tgtttgaccttcatgakaagctattacagaatt

SEQ ID NO: 8482 - DNA, 33 bp, homo sapien
caattcagttgtgatakctccttgattttcggg

SEQ ID NO: 8483 - DNA, 33 bp, homo sapien
cagtaatctcctcactrtggaaacattggagaa

SEQ ID NO: 8484 - DNA, 33 bp, homo sapien
cagacattattttatcrtttctgtcattttctt

SEQ ID NO: 8485 - DNA, 33 bp, homo sapien
gaccatccacatggcaraggtatggtggccaag

SEQ ID NO: 8486 - DNA, 33 bp, homo sapien
ggaagccattcttgagstaagtaagaagtagta

SEQ ID NO: 8487 - DNA, 33 bp, homo sapien
cacgtttttagactccrcagcttcgctccctgg

SEQ ID NO: 8488 - DNA, 33 bp, homo sapien
tcccatgacgagttacrgaaggtagaaccttta

SEQ ID NO: 8489 - DNA, 33 bp, homo sapien
ttggtgctgcatttgtytataaatttagaatca

SEQ ID NO: 8490 - DNA, 33 bp, homo sapien
caataaattgatatgcrgatgaattatccaaaa

SEQ ID NO: 8491 - DNA, 33 bp, homo sapien
ggatcatattatacacsttgttctgtatcttgc

SEQ ID NO: 8492 - DNA, 33 bp, homo sapien
attaaaatatggttaaygataatggtctccact

SEQ ID NO: 8493 - DNA, 33 bp, homo sapien
acaacggtagagtaatraactatgatgctaaat

SEQ ID NO: 8494 - DNA, 33 bp, homo sapien
catttcattgctctctrtcaatacctggagaat

SEQ ID NO: 8495 - DNA, 33 bp, homo sapien
agaaaaatcctgattcrcttagctttggcttta

SEQ ID NO: 8496 - DNA, 33 bp, homo sapien
tgtattgctagccctgscaactgaagacaaact

SEQ ID NO: 8497 - DNA, 33 bp, homo sapien
actttaccacataggcrtgactggcacatatgc

SEQ ID NO: 8498 - DNA, 33 bp, homo sapien
aatttgtttcaaagtayatgtaacatttatcaa

SEQ ID NO: 8499 - DNA, 33 bp, homo sapien
tattggtgtttctactytttagcatacagatct

SEQ ID NO: 8500 - DNA, 33 bp, homo sapien
atgaccaccagtagaawttcctccttatcaagg

SEQ ID NO: 8501 - DNA, 33 bp, homo sapien
gagctggtgccgttccyatcgacagcagccatg

SEQ ID NO: 8502 - DNA, 33 bp, homo sapien
tatttccttttacaaayttacagaaactgaata

SEQ ID NO: 8503 - DNA, 33 bp, homo sapien
aatggataagaattgamcaaccaaatatctgct

SEQ ID NO: 8504 - DNA, 33 bp, homo sapien
taccaaatacttccagrtccttatggagcaccc

SEQ ID NO: 8505 - DNA, 33 bp, homo sapien
cacactgcctgctgcastttctcagtatggcaa

SEQ ID NO: 8506 - DNA, 33 bp, homo sapien
cagatacagaggttcartcctagggctcatgac

SEQ ID NO: 8507 - DNA, 33 bp, homo sapien
aactggtggttctgaayactggagttgaatttc

SEQ ID NO: 8508 - DNA, 33 bp, homo sapien
atcttagagtcccgatyagctagttttcaggtg

SEQ ID NO: 8509 - DNA, 33 bp, homo sapien
agaaagatattgggtgyttattccctggctccc

SEQ ID NO: 8510 - DNA, 33 bp, homo sapien
gacttcgagttgtctgktcactttagtgagggg

SEQ ID NO: 8511 - DNA, 33 bp, homo sapien
gatgcttactcttcctygagtcagtgcaggtgg

SEQ ID NO: 8512 - DNA, 33 bp, homo sapien
cttctccagatggaagwtgttctttaagggatg

SEQ ID NO: 8513 - DNA, 33 bp, homo sapien
ctccacagatctactcraacaagaaagcccttt

SEQ ID NO: 8514 - DNA, 33 bp, homo sapien
ttttgccaattctcaaktatttcaaatccataa

SEQ ID NO: 8515 - DNA, 33 bp, homo sapien
gcaaattcactacaaargattgaagcaaaaagg

SEQ ID NO: 8516 - DNA, 33 bp, homo sapien
gagttagctttgtaacratttaggcgctacctc

SEQ ID NO: 8517 - DNA, 33 bp, homo sapien
tttccaatgcttgtcarttctgcctttaatttc

SEQ ID NO: 8518 - DNA, 33 bp, homo sapien
aaggatgagtcatcgcmaaccaccatgaatgat

SEQ ID NO: 8519 - DNA, 33 bp, homo sapien
ctttctggcatctccartagtaatcatgtctct

SEQ ID NO: 8520 - DNA, 33 bp, homo sapien
tttttgttgttgtaaakgtgtgggcaatgttct

SEQ ID NO: 8521 - DNA, 33 bp, homo sapien
accacctaaagcccaamccaaaaaatcaaatgc

SEQ ID NO: 8522 - DNA, 33 bp, homo sapien
ggaaacagaggataaayaggacagtgataaata

SEQ ID NO: 8523 - DNA, 33 bp, homo sapien
taaatataaaatagaaygatgaatgctaaaatc

SEQ ID NO: 8524 - DNA, 33 bp, homo sapien
taaagactttccatctsaattgtacagacaacc

SEQ ID NO: 8525 - DNA, 33 bp, homo sapien
gacatgctactcacaaycaggatgtcaggaggg

SEQ ID NO: 8526 - DNA, 33 bp, homo sapien
tagtacatctccgcatragtcatattttgtacc

SEQ ID NO: 8527 - DNA, 33 bp, homo sapien
aaataagtatgattacrgagtgaagacatttca

SEQ ID NO: 8528 - DNA, 33 bp, homo sapien
aacaacatacagacatrgaagaaacaccctatt

SEQ ID NO: 8529 - DNA, 33 bp, homo sapien
ctacctccattcatttrccgccttacctggaaa

SEQ ID NO: 8530 - DNA, 33 bp, homo sapien
tctcatccgggtcctcyatccacaggggctgac

SEQ ID NO: 8531 - DNA, 33 bp, homo sapien
tgagcataggctgttakaagaagccatatcatt

SEQ ID NO: 8532 - DNA, 33 bp, homo sapien
gagttctattttgatayagtttgttagaacctg

SEQ ID NO: 8533 - DNA, 33 bp, homo sapien
caaattcaaaaggataygcactggctttttctg

SEQ ID NO: 8534 - DNA, 33 bp, homo sapien
ccttctgatcaactacsacattcatgccaatga

SEQ ID NO: 8535 - DNA, 33 bp, homo sapien
agattatcaatgattaraaagactaaaaataac

SEQ ID NO: 8536 - DNA, 33 bp, homo sapien
aaggcactggagagtcygcagtgaccaattgga

SEQ ID NO: 8537 - DNA, 33 bp, homo sapien
taatggtacacatagtrgattcatagtacacat

SEQ ID NO: 8538 - DNA, 33 bp, homo sapien
aggcagaggcttcagcrtaagatcccacagctt

SEQ ID NO: 8539 - DNA, 33 bp, homo sapien
atgaagaggcctgtacrttcgtttaattaacac

SEQ ID NO: 8540 - DNA, 33 bp, homo sapien
aagcagcatagagcacrtaagctttcacacaga

SEQ ID NO: 8541 - DNA, 33 bp, homo sapien
aggcaagtatgatattratagtgggctggccag

SEQ ID NO: 8542 - DNA, 33 bp, homo sapien
ttcttaggtgacttttyggagaagattagggaa

SEQ ID NO: 8543 - DNA, 33 bp, homo sapien
tgagtggaatcctccaraaatgaacacagattc

SEQ ID NO: 8544 - DNA, 33 bp, homo sapien
ccactgcagtccatttrtgcaaaataatcattt

SEQ ID NO: 8545 - DNA, 33 bp, homo sapien
tagctagagagaagtcratgcttagctttgaag

SEQ ID NO: 8546 - DNA, 33 bp, homo sapien
atggaataaggaatccrgtaacttgaaggcaga

SEQ ID NO: 8547 - DNA, 33 bp, homo sapien
tactgttaccttcttcwtctatgcacactccta

SEQ ID NO: 8548 - DNA, 33 bp, homo sapien
gtgtgactgctggtgcrtatggtaagtgtggtt

SEQ ID NO: 8549 - DNA, 33 bp, homo sapien
agaagtggtctgacagsttccgtggtcccttag

SEQ ID NO: 8550 - DNA, 33 bp, homo sapien
atcattgtgaccatacrtttaaaaacaaaatgg

SEQ ID NO: 8551 - DNA, 33 bp, homo sapien
ggtggagtgacttggayaaggtggtcagggaag

SEQ ID NO: 8552 - DNA, 33 bp, homo sapien
aaatcgtgtaatgtctyatggcttttaacttag

SEQ ID NO: 8553 - DNA, 33 bp, homo sapien
tttttgatcatgattcytgagaaatattgcacc

SEQ ID NO: 8554 - DNA, 33 bp, homo sapien
ggcatggttcgtggccwaattagatcacatcaa

SEQ ID NO: 8555 - DNA, 33 bp, homo sapien
aggaatgttcttacagygatgttaccaagcaca

SEQ ID NO: 8556 - DNA, 33 bp, homo sapien
ttgtagccagtttagcyagtggaataatatttg

SEQ ID NO: 8557 - DNA, 33 bp, homo sapien
ttgttggagcttcctcrtctcccatttcgcctt

SEQ ID NO: 8558 - DNA, 33 bp, homo sapien
taaagtaccattttcayataaagcatgcacttt

SEQ ID NO: 8559 - DNA, 33 bp, homo sapien
cagtgattcctgagagmggagaaccaaatgagg

SEQ ID NO: 8560 - DNA, 33 bp, homo sapien
tgcatagatgtgtctgyacaaggtcttttaggg

SEQ ID NO: 8561 - DNA, 33 bp, homo sapien
caaagtctcttttaccrcatgaaatgacatatt

SEQ ID NO: 8562 - DNA, 33 bp, homo sapien
tgcagttggtattcacyggtgtgaccctagtac

SEQ ID NO: 8563 - DNA, 33 bp, homo sapien
gcactatttcagttttstccttctgccacatcc

SEQ ID NO: 8564 - DNA, 33 bp, homo sapien
ataatcaaagttatgtyctccaatctaaacaaa

SEQ ID NO: 8565 - DNA, 33 bp, homo sapien
tgtagctaatactctayggactgaaacacaata

SEQ ID NO: 8566 - DNA, 33 bp, homo sapien
tgaaagctgtgtaatckattgtgaagaagaggc

SEQ ID NO: 8567 - DNA, 33 bp, homo sapien
gtcaattcttgtcctcrtacacttttgaattac

SEQ ID NO: 8568 - DNA, 33 bp, homo sapien
acttgccaaaaacagaytgagcccctaggagta

SEQ ID NO: 8569 - DNA, 33 bp, homo sapien
aggaagatgcagatgcygttaaaactaagttgt

SEQ ID NO: 8570 - DNA, 33 bp, homo sapien
ataaaatacactgcaaygatttaaggtatcaaa

SEQ ID NO: 8571 - DNA, 33 bp, homo sapien
tagtgtagtgacaaagygaaagaaaagggtagt

SEQ ID NO: 8572 - DNA, 33 bp, homo sapien
ctttatcctttatgtcyttttctctgaatgtat

SEQ ID NO: 8573 - DNA, 33 bp, homo sapien
atggggaccattctttrcaggaacagtatttct

SEQ ID NO: 8574 - DNA, 33 bp, homo sapien
gccctaactttcttaarttgtatgaaggctgag

SEQ ID NO: 8575 - DNA, 33 bp, homo sapien
tgtggtgtgtctgtcaygaacccagtcagcctt

SEQ ID NO: 8576 - DNA, 33 bp, homo sapien
atccatgaacctgtaamattgcaaatggtatgt

SEQ ID NO: 8577 - DNA, 33 bp, homo sapien
cacattttacgctgacmaacccaatctaagatg

SEQ ID NO: 8578 - DNA, 33 bp, homo sapien
cctgacaactctgtgtkgctggctgcccccact

SEQ ID NO: 8579 - DNA, 33 bp, homo sapien
caagttcagaaaaaaayctgaggagagaataag

SEQ ID NO: 8580 - DNA, 33 bp, homo sapien
attctgtaggcaatttrgatgatgaaatttaat

SEQ ID NO: 8581 - DNA, 33 bp, homo sapien
ttatattcagaagaaamctttccagcaagtagg

SEQ ID NO: 8582 - DNA, 33 bp, homo sapien
agaaagctcttcaagasaggacaaactcacttt

SEQ ID NO: 8583 - DNA, 33 bp, homo sapien
cagaggagcattcatgmcactgaaaccagagta

SEQ ID NO: 8584 - DNA, 33 bp, homo sapien
gttattggccaaggacktcgtagttggaggagt

SEQ ID NO: 8585 - DNA, 33 bp, homo sapien
ggtatgaatgtcacaasggaaaaggtggaaaac

SEQ ID NO: 8586 - DNA, 33 bp, homo sapien
tgaacctaagtaatgtycattttacctattcct

SEQ ID NO: 8587 - DNA, 33 bp, homo sapien
cttatacgctactgatrgaatgtaaattagttc

SEQ ID NO: 8588 - DNA, 33 bp, homo sapien
ttgccctgccagttcarcatccttcattcggga

SEQ ID NO: 8589 - DNA, 33 bp, homo sapien
tggtttattgtgaataytacataagtgagtacg

SEQ ID NO: 8590 - DNA, 33 bp, homo sapien
gtcttcagaaacacagygagtggccctgtgctg

SEQ ID NO: 8591 - DNA, 33 bp, homo sapien
cctcatggcacccaggyttcttctgtttcacag

SEQ ID NO: 8592 - DNA, 33 bp, homo sapien
ttgtaacctttctctcmggctgctctctgcctg

SEQ ID NO: 8593 - DNA, 33 bp, homo sapien
aatgaatgaactccatsgatgtctcctgaatat

SEQ ID NO: 8594 - DNA, 33 bp, homo sapien
ccacattgttcttcaaygtcctactctgtaaga

SEQ ID NO: 8595 - DNA, 33 bp, homo sapien
atcagaaagggtcttaygagccattgaatccaa

SEQ ID NO: 8596 - DNA, 33 bp, homo sapien
ttagcttagtcccagcrtataacaattacttgc

SEQ ID NO: 8597 - DNA, 33 bp, homo sapien
aattatcttctctgacwacaaggaaataaaact

SEQ ID NO: 8598 - DNA, 33 bp, homo sapien
aacattgtcagtggaasctttcacattcttttt

SEQ ID NO: 8599 - DNA, 33 bp, homo sapien
tggaaaagtacaaaagraaagagagatattgaa

SEQ ID NO: 8600 - DNA, 33 bp, homo sapien
tgcaatacgcttttcawactttttgtgtttgaa

SEQ ID NO: 8601 - DNA, 33 bp, homo sapien
caggtcctttgctcatyttaaaatctggttgtt

SEQ ID NO: 8602 - DNA, 33 bp, homo sapien
aatcctctattcttgtrtaccgagactatatcc

SEQ ID NO: 8603 - DNA, 33 bp, homo sapien
agctaaattctactgaytttttcctacccttac

SEQ ID NO: 8604 - DNA, 33 bp, homo sapien
gagttctgccatatagycacctgtgtttcatag

SEQ ID NO: 8605 - DNA, 33 bp, homo sapien
aattaagacattgggtytgcatattgaactttt

SEQ ID NO: 8606 - DNA, 33 bp, homo sapien
gctacttactggttatrtaatcatagacaagtt

SEQ ID NO: 8607 - DNA, 33 bp, homo sapien
aggttcctggtctttcyggaggtactttagaaa

SEQ ID NO: 8608 - DNA, 33 bp, homo sapien
tgaatgtcagagatagyagtaccttgcatcaac

SEQ ID NO: 8609 - DNA, 33 bp, homo sapien
ttgtttcctgactttgstcacagtgggcttttt

SEQ ID NO: 8610 - DNA, 33 bp, homo sapien
aatgtgtttcatgcgtyttcctcctcctatgtt

SEQ ID NO: 8611 - DNA, 33 bp, homo sapien
ttgaacatattcctcarcaacagcatgcatgct

SEQ ID NO: 8612 - DNA, 33 bp, homo sapien
gtgaatgagaagggtargagacttaggactcag

SEQ ID NO: 8613 - DNA, 33 bp, homo sapien
atttaggtttctgaatycataatggcatgagaa

SEQ ID NO: 8614 - DNA, 33 bp, homo sapien
ccactgggaactaaatkgtaaaataagaacgga

SEQ ID NO: 8615 - DNA, 33 bp, homo sapien
gaaagattagttggttrtataggttactacaat

SEQ ID NO: 8616 - DNA, 33 bp, homo sapien
gaattcatgagggaaaraaacagaccaatccac

SEQ ID NO: 8617 - DNA, 33 bp, homo sapien
tattctttttttcaaarttcagtaacttgccca

SEQ ID NO: 8618 - DNA, 33 bp, homo sapien
cttgtatgattccaggytaagattggacaaaag

SEQ ID NO: 8619 - DNA, 33 bp, homo sapien
aagaattgtgttgccaytgagtttctatttcaa

SEQ ID NO: 8620 - DNA, 33 bp, homo sapien
aaacacagaaaagcackgttggctgtagccatc

SEQ ID NO: 8621 - DNA, 33 bp, homo sapien
gaaaaatgaggcttcargaagtctgtttcccca

SEQ ID NO: 8622 - DNA, 33 bp, homo sapien
ttcatcaaatgaaaccraaaggaattacagcca

SEQ ID NO: 8623 - DNA, 33 bp, homo sapien
gttgcggatgagaaatmaatcggagctgcttgt

SEQ ID NO: 8624 - DNA, 33 bp, homo sapien
atgtcgtttgcttaacrtacaccctggaaagag

SEQ ID NO: 8625 - DNA, 33 bp, homo sapien
caaagactgctaactgrtttgaacatgaagttg

SEQ ID NO: 8626 - DNA, 33 bp, homo sapien
tggtttgttggatcagyggccaagcagggtcca

SEQ ID NO: 8627 - DNA, 33 bp, homo sapien
atgtatccctaggtgckctttctcgactgtctt

SEQ ID NO: 8628 - DNA, 33 bp, homo sapien
tcattttacagacagcrgaaactgtatcttgct

SEQ ID NO: 8629 - DNA, 33 bp, homo sapien
tagctcctggaaatacwgaattctatccaacca

SEQ ID NO: 8630 - DNA, 33 bp, homo sapien
tcagcaaataaacaaayagtatgtcaggtgata

SEQ ID NO: 8631 - DNA, 33 bp, homo sapien
ctgacctgcaggagaaktgggcttcaggcacga

SEQ ID NO: 8632 - DNA, 33 bp, homo sapien
ttccttgctgaatactkttttttttgcggcaca

SEQ ID NO: 8633 - DNA, 33 bp, homo sapien
aataagtaataaaaccragacttgaacccagcc

SEQ ID NO: 8634 - DNA, 33 bp, homo sapien
ttaactgtagatcattyttcagaggtcaggtca

SEQ ID NO: 8635 - DNA, 33 bp, homo sapien
aaaaacatacactttcwttactgagatctctgc

SEQ ID NO: 8636 - DNA, 33 bp, homo sapien
atgaactggaactgcartattggatctcctggt

SEQ ID NO: 8637 - DNA, 33 bp, homo sapien
ctacaaatcatgctagraatcagtgacaaataa

SEQ ID NO: 8638 - DNA, 33 bp, homo sapien
tgattgctaacagagargtgtgaggagaaccat

SEQ ID NO: 8639 - DNA, 33 bp, homo sapien
ttttcacctaaagttcwatttaagattccattc

SEQ ID NO: 8640 - DNA, 33 bp, homo sapien
agtttgctgctatttcrgaatttctgtagagaa

SEQ ID NO: 8641 - DNA, 33 bp, homo sapien
aatgatgaaaataagcragttaccaaagcttct

SEQ ID NO: 8642 - DNA, 33 bp, homo sapien
gtcttttcaatagctawtttttactcactttaa

SEQ ID NO: 8643 - DNA, 33 bp, homo sapien
ggcacctgaataaaggrtccaaaaaccagacag

SEQ ID NO: 8644 - DNA, 33 bp, homo sapien
aatgatgaaggatagaraatggaatcctggcaa

SEQ ID NO: 8645 - DNA, 33 bp, homo sapien
ttacattccaaggcatraacttgttaaaattac

SEQ ID NO: 8646 - DNA, 33 bp, homo sapien
ttcaacaaaatggcacygagagaaccatgtgct

SEQ ID NO: 8647 - DNA, 33 bp, homo sapien
ttggacagcatatctgrttggctacaaagtgtg

SEQ ID NO: 8648 - DNA, 33 bp, homo sapien
atgacttcttagcttcrtaatgcaatgttttat

SEQ ID NO: 8649 - DNA, 33 bp, homo sapien
tagaaggatttactcasccacaaaagtgtgtga

SEQ ID NO: 8650 - DNA, 33 bp, homo sapien
ctgaaaatcttgacagraaaacctcacagtggt

SEQ ID NO: 8651 - DNA, 33 bp, homo sapien
tcatgctttgtgttttyagttgttattttcttg

SEQ ID NO: 8652 - DNA, 33 bp, homo sapien
ccatggaaactacagaraattggactcccccta

SEQ ID NO: 8653 - DNA, 33 bp, homo sapien
agagctagaattaggtyacaaatggatatcatt

SEQ ID NO: 8654 - DNA, 33 bp, homo sapien
catgcaattttgtggcyatgtttccgtgtcaga

SEQ ID NO: 8655 - DNA, 33 bp, homo sapien
ctgcaacctcgacgtcytggccttaggtgatct

SEQ ID NO: 8656 - DNA, 33 bp, homo sapien
gaatgctgacatataayctatacctgtgcgctc

SEQ ID NO: 8657 - DNA, 33 bp, homo sapien
ccctcagtaatgccaasgttctgttagcaagga

SEQ ID NO: 8658 - DNA, 33 bp, homo sapien
aggttgcgatgaggagmtagggagagaactgtt

SEQ ID NO: 8659 - DNA, 33 bp, homo sapien
tgatagattgaggtaaygctcataactgttagt

SEQ ID NO: 8660 - DNA, 33 bp, homo sapien
atctcttgtcctcaagrtttcaaaagctaaaag

SEQ ID NO: 8661 - DNA, 33 bp, homo sapien
ccacccaggttctatcrcttcctgaaataaaaa

SEQ ID NO: 8662 - DNA, 33 bp, homo sapien
atgaaataaaaaacagrtgaacaatgtaaaagt

SEQ ID NO: 8663 - DNA, 33 bp, homo sapien
aatactttggctgtaartatatagcaatttaat

SEQ ID NO: 8664 - DNA, 33 bp, homo sapien
aataccagcaaacaacmatttcttccgtgaatt

SEQ ID NO: 8665 - DNA, 33 bp, homo sapien
cgggctttgttgtttcrcttatagaacacagac

SEQ ID NO: 8666 - DNA, 33 bp, homo sapien
tttttgctctggctttygcaacatcccataatt

SEQ ID NO: 8667 - DNA, 33 bp, homo sapien
ggcaccacttggaaaayggtaaatgtaatctat

SEQ ID NO: 8668 - DNA, 33 bp, homo sapien
ctaaggctgctgtaatrtcacacactgggtgac

SEQ ID NO: 8669 - DNA, 33 bp, homo sapien
ctttctatgaggttttygatttactttgtccag

SEQ ID NO: 8670 - DNA, 33 bp, homo sapien
actgaatttgtgagatmagtctgcaaactgaat

SEQ ID NO: 8671 - DNA, 33 bp, homo sapien
aaatgaagtcagttgcrtcacaccctaagaaaa

SEQ ID NO: 8672 - DNA, 33 bp, homo sapien
agcatctctgactctcrctgatatttattaacg

SEQ ID NO: 8673 - DNA, 33 bp, homo sapien
ggaatcgggcgggcagraatacttgtctctccc

SEQ ID NO: 8674 - DNA, 33 bp, homo sapien
tttagaatgacttcctygaagccagtgtttctc

SEQ ID NO: 8675 - DNA, 33 bp, homo sapien
tactttggctttttttkgtccaactctagttat

SEQ ID NO: 8676 - DNA, 33 bp, homo sapien
atagcaatgtctcccaratttataaagacaatg

SEQ ID NO: 8677 - DNA, 33 bp, homo sapien
tggtcatgccttaaccrtgggtaacagtcatgg

SEQ ID NO: 8678 - DNA, 33 bp, homo sapien
agagcagacagggagakgcaacaaatgcaagga

SEQ ID NO: 8679 - DNA, 33 bp, homo sapien
tatctgcttctatcacracctgcagagggtgca

SEQ ID NO: 8680 - DNA, 33 bp, homo sapien
ggttatttttgcctcaktttatattagtcaagt

SEQ ID NO: 8681 - DNA, 33 bp, homo sapien
gcttgtctttagctttsaaagtagatcttgcct

SEQ ID NO: 8682 - DNA, 33 bp, homo sapien
catcaccaagtttctcytaaaaacacagaagac

SEQ ID NO: 8683 - DNA, 33 bp, homo sapien
gtacattttcaaaatgycctttgcaatgatctc

SEQ ID NO: 8684 - DNA, 33 bp, homo sapien
tgagttgaaccagtctycgggacatggaagtga

SEQ ID NO: 8685 - DNA, 33 bp, homo sapien
catgggccctaacaaaygagtgctggatttatc

SEQ ID NO: 8686 - DNA, 33 bp, homo sapien
tgagatttctggtgccytctttacaggatctaa

SEQ ID NO: 8687 - DNA, 33 bp, homo sapien
tggaatttctcttattkcaaaattctattgccc

SEQ ID NO: 8688 - DNA, 33 bp, homo sapien
tgactgtctgcccctcyataaattgccttagga

SEQ ID NO: 8689 - DNA, 33 bp, homo sapien
agcaggaaaaggctcaygcttcagtagaacgga

SEQ ID NO: 8690 - DNA, 33 bp, homo sapien
aagcaccaccacaaacygaaagctatgggacac

SEQ ID NO: 8691 - DNA, 33 bp, homo sapien
ttttgttgtcatagagkcaaatgagatgccaaa

SEQ ID NO: 8692 - DNA, 33 bp, homo sapien
gcacagctgtaaatatytcagtgctatttttaa

SEQ ID NO: 8693 - DNA, 33 bp, homo sapien
ccactgctttttatgcsttgacctttgtaccca

SEQ ID NO: 8694 - DNA, 33 bp, homo sapien
agtgatataaagctagsattaattttccatcca

SEQ ID NO: 8695 - DNA, 33 bp, homo sapien
taaagtgaaatgatggktagagtctaaaagagg

SEQ ID NO: 8696 - DNA, 33 bp, homo sapien
tgcatatttttagagcmcttctgcaacaaattc

SEQ ID NO: 8697 - DNA, 33 bp, homo sapien
catacttaactggaaartgaaacacttaaaggc

SEQ ID NO: 8698 - DNA, 33 bp, homo sapien
tgagtccaggaggaagwctgaggaaataaaagt

SEQ ID NO: 8699 - DNA, 33 bp, homo sapien
tatacaggatatgaackgagtattcaaggcgta

SEQ ID NO: 8700 - DNA, 33 bp, homo sapien
tcactgatttgtcactwtttgacctgtctggca

SEQ ID NO: 8701 - DNA, 33 bp, homo sapien
ttacagtcagtctcctrgaacatacatctgagg

SEQ ID NO: 8702 - DNA, 33 bp, homo sapien
tgaaactataaagtcasacactcttggattgac

SEQ ID NO: 8703 - DNA, 33 bp, homo sapien
cagggattctaactctyggcttcactagcagac

SEQ ID NO: 8704 - DNA, 33 bp, homo sapien
gggtactagctctgtcrtaagagtcacagctgc

SEQ ID NO: 8705 - DNA, 33 bp, homo sapien
caatgtgccatatccartcgtgttctatcttgg

SEQ ID NO: 8706 - DNA, 33 bp, homo sapien
atataaacttaaagaamacatacaaggagtgtt

SEQ ID NO: 8707 - DNA, 33 bp, homo sapien
gctgtctttcgcctggrattagcagagacttaa

SEQ ID NO: 8708 - DNA, 33 bp, homo sapien
aaaaggcacgctggcawatacttggatgggcac

SEQ ID NO: 8709 - DNA, 33 bp, homo sapien
tgagagcattggacacwctgatcaatcatgccc

SEQ ID NO: 8710 - DNA, 33 bp, homo sapien
tgtttgaatagcaaagrtgtgcgaacaaaccaa

SEQ ID NO: 8711 - DNA, 33 bp, homo sapien
aaatggccagggaagakagcagtaccatgggag

SEQ ID NO: 8712 - DNA, 33 bp, homo sapien
agtatgtattctctgargtatgaatgtctagga

SEQ ID NO: 8713 - DNA, 33 bp, homo sapien
tttttacacttttttgkttcaagttgatttttg

SEQ ID NO: 8714 - DNA, 33 bp, homo sapien
gtggcactcctcattgrcattattaatttttga

SEQ ID NO: 8715 - DNA, 33 bp, homo sapien
ttagaagtgttcctcartcttggtgctattgtc

SEQ ID NO: 8716 - DNA, 33 bp, homo sapien
aatatcaaatccactgmcaatgttatattccta

SEQ ID NO: 8717 - DNA, 33 bp, homo sapien
tcttatcacgagtcctrcgggaaaccagctgcc

SEQ ID NO: 8718 - DNA, 33 bp, homo sapien
agaattactgtcaccgktttacagatgaggcca

SEQ ID NO: 8719 - DNA, 33 bp, homo sapien
tgtgtattagtagctayggtgaacagtgctaca

SEQ ID NO: 8720 - DNA, 33 bp, homo sapien
aacataacctaaaaatrcttctcccatggacat

SEQ ID NO: 8721 - DNA, 33 bp, homo sapien
aaaaaagactgtattgwcatgaataaattccca

SEQ ID NO: 8722 - DNA, 33 bp, homo sapien
gtgataataatcagctkatagcacaggataatg

SEQ ID NO: 8723 - DNA, 33 bp, homo sapien
agtgagaaaatgtaggscttttaattccatatg

SEQ ID NO: 8724 - DNA, 33 bp, homo sapien
gcaattttattcactcrtatcgaattgggcttg

SEQ ID NO: 8725 - DNA, 33 bp, homo sapien
agttctgatcacagtgrtatatgagtagacatg

SEQ ID NO: 8726 - DNA, 33 bp, homo sapien
agtgggtcctgaatacwctcacttatgcatcta

SEQ ID NO: 8727 - DNA, 33 bp, homo sapien
gctcactggactgttcyttttggttagcaagat

SEQ ID NO: 8728 - DNA, 33 bp, homo sapien
tttttttcaagcacttyaaacttcataaacttg

SEQ ID NO: 8729 - DNA, 33 bp, homo sapien
gatgacgtttagaagtkgtccatgtataacaaa

SEQ ID NO: 8730 - DNA, 33 bp, homo sapien
agataacttagtgaaakttaagataacacagaa

SEQ ID NO: 8731 - DNA, 33 bp, homo sapien
tgaagataaaatagcasaaaacgctgaaaattc

SEQ ID NO: 8732 - DNA, 33 bp, homo sapien
ggcgtaagatgcacatrttgtagcttgggaact

SEQ ID NO: 8733 - DNA, 33 bp, homo sapien
tgtccttggacagatcrtataatctcttttagc

SEQ ID NO: 8734 - DNA, 33 bp, homo sapien
atgattgtagatgttcrtcaggcattgaagagt

SEQ ID NO: 8735 - DNA, 33 bp, homo sapien
agcctacattagaattrgtctacaccagaactt

SEQ ID NO: 8736 - DNA, 33 bp, homo sapien
atgaagtgattttaatsgtatgtccatgaaact

SEQ ID NO: 8737 - DNA, 33 bp, homo sapien
gctctcataattctagsaaagagtcctaacacc

SEQ ID NO: 8738 - DNA, 33 bp, homo sapien
atcacttttttttgcaktgcatttattcattca

SEQ ID NO: 8739 - DNA, 33 bp, homo sapien
attcacatgtgacaaargaaaagaattgataaa

SEQ ID NO: 8740 - DNA, 33 bp, homo sapien
cacaaatttgaacaaamctcttaaacagccttc

SEQ ID NO: 8741 - DNA, 33 bp, homo sapien
tctctgtggccggtttytgtaatccgggaagac

SEQ ID NO: 8742 - DNA, 33 bp, homo sapien
aataggaactggaattyttagactgaaaggaaa

SEQ ID NO: 8743 - DNA, 33 bp, homo sapien
caatcaattaatgtaawctaccaaatcaacaga

SEQ ID NO: 8744 - DNA, 33 bp, homo sapien
aacaggggagaagtcamtgtgaaaaaggaggaa

SEQ ID NO: 8745 - DNA, 33 bp, homo sapien
tcctcccacagaagcgkgtagatctgctggagc

SEQ ID NO: 8746 - DNA, 33 bp, homo sapien
tccatcagtaaacatastcaagtctctattttc

SEQ ID NO: 8747 - DNA, 33 bp, homo sapien
tgcagcagggatgaaarcaaaattaatttactt

SEQ ID NO: 8748 - DNA, 33 bp, homo sapien
taactaaaaaactgctktgccttttgtattatc

SEQ ID NO: 8749 - DNA, 33 bp, homo sapien
ctcctgcttctgttttyccacctgccattaccc

SEQ ID NO: 8750 - DNA, 33 bp, homo sapien
attcatacattttgtgmaatagtcacctggatc

SEQ ID NO: 8751 - DNA, 33 bp, homo sapien
ccacaagaagctagaaragccaaggaaggattc

SEQ ID NO: 8752 - DNA, 33 bp, homo sapien
acatgaataaaaaagckaaacagccttattggt

SEQ ID NO: 8753 - DNA, 33 bp, homo sapien
caaaagagactgtgaargaacagctagagaaat

SEQ ID NO: 8754 - DNA, 33 bp, homo sapien
aaaaccaaaaactgggygcagtaatgagaagaa

SEQ ID NO: 8755 - DNA, 33 bp, homo sapien
atttcttaaggtgaaaktgacttgactttgccc

SEQ ID NO: 8756 - DNA, 33 bp, homo sapien
ctttcagatggctatgyaataggttccctttag

SEQ ID NO: 8757 - DNA, 33 bp, homo sapien
gaagtgcaaccatggartacttgagtgggagtg

SEQ ID NO: 8758 - DNA, 33 bp, homo sapien
cccatgtcacttgattmgatgccctctgttctt

SEQ ID NO: 8759 - DNA, 33 bp, homo sapien
cactcctgagtcctttygaaaccactgtccatg

SEQ ID NO: 8760 - DNA, 33 bp, homo sapien
gatggagctgctgcatwagaaacgaaactgcag

SEQ ID NO: 8761 - DNA, 33 bp, homo sapien
atccagcagtaaaggtsagcagctgagggggat

SEQ ID NO: 8762 - DNA, 33 bp, homo sapien
tagtcttcattgtgtcrtcttcattgaaaaagg

SEQ ID NO: 8763 - DNA, 33 bp, homo sapien
ctcactaagaatcaaaygaatggttattttctc

SEQ ID NO: 8764 - DNA, 33 bp, homo sapien
tcactctattggtactrttaactgccaaccact

SEQ ID NO: 8765 - DNA, 33 bp, homo sapien
aattggccttggttgamttggatcagactgtgg

SEQ ID NO: 8766 - DNA, 33 bp, homo sapien
gtttgatgtaatcatcwgatccactttttagaa

SEQ ID NO: 8767 - DNA, 33 bp, homo sapien
ataatttttttcatggragataagttgaaagat

SEQ ID NO: 8768 - DNA, 33 bp, homo sapien
ttgggataaatgcacasatgtcaaggtgttcaa

SEQ ID NO: 8769 - DNA, 33 bp, homo sapien
ctaattgggccagactyttcctatgtggggaca

SEQ ID NO: 8770 - DNA, 33 bp, homo sapien
ccaggcctgtactgacrctggcccaggtccgat

SEQ ID NO: 8771 - DNA, 33 bp, homo sapien
ttggctgaagcaatacraaaaggatagttcatt

SEQ ID NO: 8772 - DNA, 33 bp, homo sapien
tcccaggtgattttaakgcaggaggtcctgagt

SEQ ID NO: 8773 - DNA, 33 bp, homo sapien
tccggtctgttaaaaartgcctccttttctgag

SEQ ID NO: 8774 - DNA, 33 bp, homo sapien
atgctcctggcaattamtaggaaccaagcactc

SEQ ID NO: 8775 - DNA, 33 bp, homo sapien
aaaagtcctatataacrtcttccaatataagat

SEQ ID NO: 8776 - DNA, 33 bp, homo sapien
gacctgagttcaaatcrtgactttgccaattac

SEQ ID NO: 8777 - DNA, 33 bp, homo sapien
ccagtatgtatgtattsagatgagtttcaagaa

SEQ ID NO: 8778 - DNA, 33 bp, homo sapien
gtgggaaaggtggattktctgtcactgaacaca

SEQ ID NO: 8779 - DNA, 33 bp, homo sapien
tatagagagagatattsacatttaattactgaa

SEQ ID NO: 8780 - DNA, 33 bp, homo sapien
aaaccacatgagcagargagttaaagcttgtat

SEQ ID NO: 8781 - DNA, 33 bp, homo sapien
actagaatttgaaagaygctaagaagccacatg

SEQ ID NO: 8782 - DNA, 33 bp, homo sapien
ttggtcttgagagtacrtggcatttcaaagtca

SEQ ID NO: 8783 - DNA, 33 bp, homo sapien
accgctgccaggatccrgtaacctcccaccagg

SEQ ID NO: 8784 - DNA, 33 bp, homo sapien
tgggcagtttggattaragaatcgcaaacgccc

SEQ ID NO: 8785 - DNA, 33 bp, homo sapien
taagaagtgagaagttytgcctgtggaggagtg

SEQ ID NO: 8786 - DNA, 33 bp, homo sapien
cccagcatattcctagmtatggtagctatggag

SEQ ID NO: 8787 - DNA, 33 bp, homo sapien
caagcctctgagacttwggcgagccaggcaata

SEQ ID NO: 8788 - DNA, 33 bp, homo sapien
tcatgacagataatccrctgctgtgttttcaaa

SEQ ID NO: 8789 - DNA, 33 bp, homo sapien
atcagcttaataaaacrattgcactttgcctca

SEQ ID NO: 8790 - DNA, 33 bp, homo sapien
gttgcatgtttcaaatktatgaatccctaaatc

SEQ ID NO: 8791 - DNA, 33 bp, homo sapien
atggaaatgtgaggaarggatgcatttggtatg

SEQ ID NO: 8792 - DNA, 33 bp, homo sapien
gaatgacagtgttcgaygagaccaaaatggaag

SEQ ID NO: 8793 - DNA, 33 bp, homo sapien
tagtgtgctttctcacrgtaaatcaagtccaga

SEQ ID NO: 8794 - DNA, 33 bp, homo sapien
gaaacaacaacaaaaargggctgcctttccatc

SEQ ID NO: 8795 - DNA, 33 bp, homo sapien
caactattatgtggagragcaactgcttattga

SEQ ID NO: 8796 - DNA, 33 bp, homo sapien
caaagggaaaatatgargcagccaccttacagt

SEQ ID NO: 8797 - DNA, 33 bp, homo sapien
attggtgtatcgattcytattgactttatttgt

SEQ ID NO: 8798 - DNA, 33 bp, homo sapien
taacatttcagtaaaakgaaagagtaagccaag

SEQ ID NO: 8799 - DNA, 33 bp, homo sapien
aacatgggctatctctycgtttacttaggtatt

SEQ ID NO: 8800 - DNA, 33 bp, homo sapien
tttgttctttacagagyctcattatattgctcg

SEQ ID NO: 8801 - DNA, 33 bp, homo sapien
aaggttaagtagcattyccagagtgacagaaga

SEQ ID NO: 8802 - DNA, 33 bp, homo sapien
cattcatttgtgtttaygcatttaccttcaggt

SEQ ID NO: 8803 - DNA, 33 bp, homo sapien
ttctgcgtgctcggatyttaccacatacttgtc

SEQ ID NO: 8804 - DNA, 33 bp, homo sapien
actttggcatttgatgrtctagtcactctgtaa

SEQ ID NO: 8805 - DNA, 33 bp, homo sapien
aatatatacattttcartcctcagagatggaaa

SEQ ID NO: 8806 - DNA, 33 bp, homo sapien
tattcatgtacctaacmgcatatgtatcagcat

SEQ ID NO: 8807 - DNA, 33 bp, homo sapien
ttccttcaagtaaggtsactccagaaagttaaa

SEQ ID NO: 8808 - DNA, 33 bp, homo sapien
ataataaaaatcagtcktacttagttggctgga

SEQ ID NO: 8809 - DNA, 33 bp, homo sapien
ctggtgataggaagacygcactttgcaatcaca

SEQ ID NO: 8810 - DNA, 33 bp, homo sapien
cctcctgaacaatctcktgtatctacagcttga

SEQ ID NO: 8811 - DNA, 33 bp, homo sapien
tctctcctgaagtcttyttgcagttactaatta

SEQ ID NO: 8812 - DNA, 33 bp, homo sapien
ctaatactcaaatgctygtaagaatatgacaac

SEQ ID NO: 8813 - DNA, 33 bp, homo sapien
ctatacctttaatgcamctccatcaaaatccca

SEQ ID NO: 8814 - DNA, 33 bp, homo sapien
agtgagtctcctgtttytgattgtagctgggca

SEQ ID NO: 8815 - DNA, 33 bp, homo sapien
cttccagaaaacaatcrtaaagaaggcaatgtt

SEQ ID NO: 8816 - DNA, 33 bp, homo sapien
taaaggattcatcatcrttaggtgtcacccggg

SEQ ID NO: 8817 - DNA, 33 bp, homo sapien
acaggtgtactgttaaygagcagtaatcttttg

SEQ ID NO: 8818 - DNA, 33 bp, homo sapien
cactcatagttttctaytggaccccaccatgta

SEQ ID NO: 8819 - DNA, 33 bp, homo sapien
cattagcaactaaatarctgcacaggcttagat

SEQ ID NO: 8820 - DNA, 33 bp, homo sapien
ttcaagactctcttctsttttatagatgtaatt

SEQ ID NO: 8821 - DNA, 33 bp, homo sapien
tgtttcacgtgtacatwggcatacccactcaca

SEQ ID NO: 8822 - DNA, 33 bp, homo sapien
atgaacatttgtatttyagttgcatcagttgta

SEQ ID NO: 8823 - DNA, 33 bp, homo sapien
aatgatcaccaatggcyactaaaatcatcagct

SEQ ID NO: 8824 - DNA, 33 bp, homo sapien
aggcccacgtgttcttyagtcagcttttggtga

SEQ ID NO: 8825 - DNA, 33 bp, homo sapien
ggggaaattgaggatgsctaatgggtaacaaaa

SEQ ID NO: 8826 - DNA, 33 bp, homo sapien
ctcagcacatgagttgyctactgacatgttgca

SEQ ID NO: 8827 - DNA, 33 bp, homo sapien
tctttctgattctatcmtgagttactctactcc

SEQ ID NO: 8828 - DNA, 33 bp, homo sapien
aggtactaacatgaacyaggaaaagctgaatca

SEQ ID NO: 8829 - DNA, 33 bp, homo sapien
acgcaggtagtgagaayactaggaaaatagaaa

SEQ ID NO: 8830 - DNA, 33 bp, homo sapien
cacctaactaaatagcytttcatctttccttca

SEQ ID NO: 8831 - DNA, 33 bp, homo sapien
ttgtctgcaggattcakcaccaagagctctcaa

SEQ ID NO: 8832 - DNA, 33 bp, homo sapien
aaattacctattttgcytgatgagatttactta

SEQ ID NO: 8833 - DNA, 33 bp, homo sapien
ctagtgaataaaaaagrtaatgcaggtactgta

SEQ ID NO: 8834 - DNA, 33 bp, homo sapien
accaagaaaggaaacarttatcagtactactat

SEQ ID NO: 8835 - DNA, 33 bp, homo sapien
cttgttcttactgatcrtttataaaaggtgtta

SEQ ID NO: 8836 - DNA, 33 bp, homo sapien
gggcaagtcactgaaaygtgggtcagatgttga

SEQ ID NO: 8837 - DNA, 33 bp, homo sapien
tacaactgggaaccacrttaaggtatatactca

SEQ ID NO: 8838 - DNA, 33 bp, homo sapien
actaggctggtggcaaytctggctcccctgaga

SEQ ID NO: 8839 - DNA, 33 bp, homo sapien
agtggattttaaatatrctacacctcagggacc

SEQ ID NO: 8840 - DNA, 33 bp, homo sapien
cttagctcaggccactscaacaaaataccttgg

SEQ ID NO: 8841 - DNA, 33 bp, homo sapien
tgagtttaccaatcaaygtgtacacttaatgca

SEQ ID NO: 8842 - DNA, 33 bp, homo sapien
tggtggaaatctgtacytgcattatactggaga

SEQ ID NO: 8843 - DNA, 33 bp, homo sapien
tgtcatccctttaacaycattaccatggaaaca

SEQ ID NO: 8844 - DNA, 33 bp, homo sapien
atacaagatgatgtttrtatttccatgtaaatg

SEQ ID NO: 8845 - DNA, 33 bp, homo sapien
tgtctgccatcaggagwtaataaaaagttctaa

SEQ ID NO: 8846 - DNA, 33 bp, homo sapien
tgtagacagcactgaartacagatcactgaaat

SEQ ID NO: 8847 - DNA, 33 bp, homo sapien
aaactggaataatgcargaggtagtatggtaac

SEQ ID NO: 8848 - DNA, 33 bp, homo sapien
cttccatgctccatgamataattgcttttgaat

SEQ ID NO: 8849 - DNA, 33 bp, homo sapien
tacaatcattgacaggyattttggcaactctgt

SEQ ID NO: 8850 - DNA, 33 bp, homo sapien
ttcctgttaacagagtyctaactgagctggttt

SEQ ID NO: 8851 - DNA, 33 bp, homo sapien
accaaacaaaactgaayaggaactcaagtcact

SEQ ID NO: 8852 - DNA, 33 bp, homo sapien
aagggatgatctttcawggtatcgttgggagtg

SEQ ID NO: 8853 - DNA, 33 bp, homo sapien
tgagggagaatctgttygatgcctctcctagct

SEQ ID NO: 8854 - DNA, 33 bp, homo sapien
ctttttgtatttggatktctggatctctatcaa

SEQ ID NO: 8855 - DNA, 33 bp, homo sapien
gaataatgattcttaartaacatcatgcagaga

SEQ ID NO: 8856 - DNA, 33 bp, homo sapien
taggatgcatgaggttragagcaatattttttt

SEQ ID NO: 8857 - DNA, 33 bp, homo sapien
ccatattatttccatcwttccattgtgtcaccc

SEQ ID NO: 8858 - DNA, 33 bp, homo sapien
cataatacaaatctagyttccgaaagctctgaa

SEQ ID NO: 8859 - DNA, 33 bp, homo sapien
atactctgctgtctaaratccttttcatgtcat

SEQ ID NO: 8860 - DNA, 33 bp, homo sapien
gggagaaaaaagtgtgscttcacaataatggga

SEQ ID NO: 8861 - DNA, 33 bp, homo sapien
gagactgtcttcctatwcattttcagaaaggca

SEQ ID NO: 8862 - DNA, 33 bp, homo sapien
ttttcacaacttacatyggttttcagatttaag

SEQ ID NO: 8863 - DNA, 33 bp, homo sapien
aatatcttaaccattcrcagagaaagcagcaat

SEQ ID NO: 8864 - DNA, 33 bp, homo sapien
ttggcaacattgatcaycagagttaaggagggc

SEQ ID NO: 8865 - DNA, 33 bp, homo sapien
ctgcttcctgttagagscttgatcaactgctag

SEQ ID NO: 8866 - DNA, 33 bp, homo sapien
atgaccaggagaaagawgacaaccagccagcca

SEQ ID NO: 8867 - DNA, 33 bp, homo sapien
cctgttttcatgactgsaatgactgctcctggg

SEQ ID NO: 8868 - DNA, 33 bp, homo sapien
gattggaaaaggcctgycagtagagcaaaacaa

SEQ ID NO: 8869 - DNA, 33 bp, homo sapien
tcacctcaccaaaagckttgtctgtaaatcact

SEQ ID NO: 8870 - DNA, 33 bp, homo sapien
tatataactctccaaayggacccaggttgtgag

SEQ ID NO: 8871 - DNA, 33 bp, homo sapien
aatattgttcaggcaargaagaaggagttttca

SEQ ID NO: 8872 - DNA, 33 bp, homo sapien
cattgagtctggttatytctatttaaatggagc

SEQ ID NO: 8873 - DNA, 33 bp, homo sapien
ccaggtcctggggatasagaaatggagaagccc

SEQ ID NO: 8874 - DNA, 33 bp, homo sapien
atggcactctcagtgtytccgtaaatttgtcta

SEQ ID NO: 8875 - DNA, 33 bp, homo sapien
gcacatatctacagaartaattgtctctctcaa

SEQ ID NO: 8876 - DNA, 33 bp, homo sapien
aaggtgaggccaagagratttcctggcggcttg

SEQ ID NO: 8877 - DNA, 33 bp, homo sapien
gaacaaaatatgaacaraaatatcctagtgaaa

SEQ ID NO: 8878 - DNA, 33 bp, homo sapien
agtttgcaatgaatggrctggccacaaaaatat

SEQ ID NO: 8879 - DNA, 33 bp, homo sapien
catggaggtcaatactsaaaacttaaagtttac

SEQ ID NO: 8880 - DNA, 33 bp, homo sapien
gacatgcccattatgarcaaggcactggctggg

SEQ ID NO: 8881 - DNA, 33 bp, homo sapien
tctcacaccaagttttrtgggttctccctgtgt

SEQ ID NO: 8882 - DNA, 33 bp, homo sapien
tccacacttgctctttyggaaaggtgtgctgat

SEQ ID NO: 8883 - DNA, 33 bp, homo sapien
cttatctcctttctctyggatcaattacagagg

SEQ ID NO: 8884 - DNA, 33 bp, homo sapien
taataaaatctccttgytgaatcctcgattatg

SEQ ID NO: 8885 - DNA, 33 bp, homo sapien
tttctaatccattgacygatggcccagaacaat

SEQ ID NO: 8886 - DNA, 33 bp, homo sapien
ctcacaccatcgagagyactaacgagaatgtga

SEQ ID NO: 8887 - DNA, 33 bp, homo sapien
gggacaggcttaaatamatgcaagaacttcatt

SEQ ID NO: 8888 - DNA, 33 bp, homo sapien
cctgtcattgtggtcaraaaccacgagctacac

SEQ ID NO: 8889 - DNA, 33 bp, homo sapien
ctatctatggcagttayggatgtatgaaatata

SEQ ID NO: 8890 - DNA, 33 bp, homo sapien
ccatgtgccagccaccrtgccaaacactttata

SEQ ID NO: 8891 - DNA, 33 bp, homo sapien
aatcttctagtgtagawcctgtgaatattgttg

SEQ ID NO: 8892 - DNA, 33 bp, homo sapien
agaaattgtattcattkgttttcattgttagtt

SEQ ID NO: 8893 - DNA, 33 bp, homo sapien
cacctgaaagagctaakagttacctcaaattca

SEQ ID NO: 8894 - DNA, 33 bp, homo sapien
tctaatggtttccaggyttacagaggaggcaca

SEQ ID NO: 8895 - DNA, 33 bp, homo sapien
gtgatctgagtcacttytcagcaacatctcagg

SEQ ID NO: 8896 - DNA, 33 bp, homo sapien
agtcctgcgagaataasaagtggacaagtaaaa

SEQ ID NO: 8897 - DNA, 33 bp, homo sapien
tagggcttagtgatatmtttccacctctgtttt

SEQ ID NO: 8898 - DNA, 33 bp, homo sapien
aataaaggctttagcartgaacttttaagatag

SEQ ID NO: 8899 - DNA, 33 bp, homo sapien
tgatgtcctattaaaasaattttggcaactatt

SEQ ID NO: 8900 - DNA, 33 bp, homo sapien
tctacagataaatgatyaataacagtgtcaatt

SEQ ID NO: 8901 - DNA, 33 bp, homo sapien
ggatggaacctaagatractcaataatctcccc

SEQ ID NO: 8902 - DNA, 33 bp, homo sapien
cgaaaaaacaagtccarggtgaaatagtgttaa

SEQ ID NO: 8903 - DNA, 33 bp, homo sapien
gtgtctgagccagaaawttccttcagtgagaca

SEQ ID NO: 8904 - DNA, 33 bp, homo sapien
gggcagggcctctaggktgacacagtcaatata

SEQ ID NO: 8905 - DNA, 33 bp, homo sapien
tggaacactttggaacwctgtggaaagccaagg

SEQ ID NO: 8906 - DNA, 33 bp, homo sapien
gctgtaatgaactatgraaacatttttaaaatt

SEQ ID NO: 8907 - DNA, 33 bp, homo sapien
agaaatgttctaacagygaattttgagtgaaag

SEQ ID NO: 8908 - DNA, 33 bp, homo sapien
acaggtccataatataytcaacaagtggcagat

SEQ ID NO: 8909 - DNA, 33 bp, homo sapien
ttctcatgcctgccaaygcaacatccattctgc

SEQ ID NO: 8910 - DNA, 33 bp, homo sapien
aaggaaatacctcaatycttatgcttcaggctg

SEQ ID NO: 8911 - DNA, 33 bp, homo sapien
catcatgtactatggcrgcaaatcctgcaaaat

SEQ ID NO: 8912 - DNA, 33 bp, homo sapien
agcgattaccttatcaytgccttgaattcctca

SEQ ID NO: 8913 - DNA, 33 bp, homo sapien
tcagtatgttagaaccraagtgctaagttaatg

SEQ ID NO: 8914 - DNA, 33 bp, homo sapien
gaacgagttttcacatrtgcatatacccctgta

SEQ ID NO: 8915 - DNA, 33 bp, homo sapien
cttggaatgattgttcygagggttttgtaaaat

SEQ ID NO: 8916 - DNA, 33 bp, homo sapien
aacttgtgtccatttastatgttgttggctgtg

SEQ ID NO: 8917 - DNA, 33 bp, homo sapien
agagacagctcccaaaycaaatcctattcaaga

SEQ ID NO: 8918 - DNA, 33 bp, homo sapien
gtgatgcagttcagtgkaatgttagagagcaac

SEQ ID NO: 8919 - DNA, 33 bp, homo sapien
acactgatgaaactggktatctgcgttcgcttg

SEQ ID NO: 8920 - DNA, 33 bp, homo sapien
gcttctgtttatagagyacatccacagtataca

SEQ ID NO: 8921 - DNA, 33 bp, homo sapien
ctgcttcaattataacycaacctactaatcaaa

SEQ ID NO: 8922 - DNA, 33 bp, homo sapien
taaaaacaaacaaatgsaattacatcaggttaa

SEQ ID NO: 8923 - DNA, 33 bp, homo sapien
gggggtcctttccaatrgagtgagcagttgtcc

SEQ ID NO: 8924 - DNA, 33 bp, homo sapien
cctcactatcactggcytgactaccactggacc

SEQ ID NO: 8925 - DNA, 33 bp, homo sapien
gttctagttcatgaggygttaagaaggagaggt

SEQ ID NO: 8926 - DNA, 33 bp, homo sapien
aggtgaggaagactatyttcttgccttgggcaa

SEQ ID NO: 8927 - DNA, 33 bp, homo sapien
atcagctcaaaataaascaaggaaagaaaggaa

SEQ ID NO: 8928 - DNA, 33 bp, homo sapien
tcaaaacagctttgatrgaatcagattcctcct

SEQ ID NO: 8929 - DNA, 33 bp, homo sapien
tgtgtcacttaatgacratgatacattctgaga

SEQ ID NO: 8930 - DNA, 33 bp, homo sapien
gaaaacaataagctgtrgaacgaacattactca

SEQ ID NO: 8931 - DNA, 33 bp, homo sapien
caagagagttttaaaaytgacatgcaatacaag

SEQ ID NO: 8932 - DNA, 33 bp, homo sapien
agagaaaagaaaatttygatgaggttcctataa

SEQ ID NO: 8933 - DNA, 33 bp, homo sapien
tcacaaattgccatctkaaaaactaaaacactt

SEQ ID NO: 8934 - DNA, 33 bp, homo sapien
taatctttctgtgactrttacctgcctgacaaa

SEQ ID NO: 8935 - DNA, 33 bp, homo sapien
tttcctcctgagcaacrtgactgagtattccat

SEQ ID NO: 8936 - DNA, 33 bp, homo sapien
gatctgaaacggacaasgaactggaagaaatgt

SEQ ID NO: 8937 - DNA, 33 bp, homo sapien
aagaattgcttatgctygaattgatttgttctg

SEQ ID NO: 8938 - DNA, 33 bp, homo sapien
ctgttgtttctcctttktatcacagcatcatac

SEQ ID NO: 8939 - DNA, 33 bp, homo sapien
gggagtctaatactttsaggaagaaacaacaac

SEQ ID NO: 8940 - DNA, 33 bp, homo sapien
cagtgtagcattttttwaagtctgttacagtgt

SEQ ID NO: 8941 - DNA, 33 bp, homo sapien
tggccacaaattccacrttaattcttagatctg

SEQ ID NO: 8942 - DNA, 33 bp, homo sapien
gaggacatgaaggaacrgctcaggtctcagtct

SEQ ID NO: 8943 - DNA, 33 bp, homo sapien
gaactcacttactatcrtgcgaacagcagcatg

SEQ ID NO: 8944 - DNA, 33 bp, homo sapien
tgatgtacaaaaagaaycagataaatgatggaa

SEQ ID NO: 8945 - DNA, 33 bp, homo sapien
ttcttcccatgttatamttccctgtctttccag

SEQ ID NO: 8946 - DNA, 33 bp, homo sapien
tttaccactttatcacygctcctccttgtactt

SEQ ID NO: 8947 - DNA, 33 bp, homo sapien
atggaaaaaaatgaccragaatagccaacacaa

SEQ ID NO: 8948 - DNA, 33 bp, homo sapien
agctcatctcagctttygatatgcctccctaag

SEQ ID NO: 8949 - DNA, 33 bp, homo sapien
agctagaattctgactygctgatttatcgtgct

SEQ ID NO: 8950 - DNA, 33 bp, homo sapien
ctcttgctttcctgaartcaatcagaagccatt

SEQ ID NO: 8951 - DNA, 33 bp, homo sapien
caatgctgtgcccatcraactaccaattacatt

SEQ ID NO: 8952 - DNA, 33 bp, homo sapien
actgacttggaaagaaytgattacctgaaggac

SEQ ID NO: 8953 - DNA, 33 bp, homo sapien
gcagcagctcttacagkctcttcaaggtaacga

SEQ ID NO: 8954 - DNA, 33 bp, homo sapien
gacagatgatcagctarttccacaaataagtta

SEQ ID NO: 8955 - DNA, 33 bp, homo sapien
atgaatagtcaaaaatygtgtgttctaaaagca

SEQ ID NO: 8956 - DNA, 33 bp, homo sapien
ccttttctgaaggactrtgaagcttggctcggg

SEQ ID NO: 8957 - DNA, 33 bp, homo sapien
acactcataagcctgcraaaataagatttaaca

SEQ ID NO: 8958 - DNA, 33 bp, homo sapien
gtttagtgaaggaatgmgggaacaatgaataaa

SEQ ID NO: 8959 - DNA, 33 bp, homo sapien
agaaaggaggactccayggtgcaggcagagaaa

SEQ ID NO: 8960 - DNA, 33 bp, homo sapien
tgtttgtttaaagccaytagtattagtacaata

SEQ ID NO: 8961 - DNA, 33 bp, homo sapien
tgctaattttggctgcrctttgaaggtaggaaa

SEQ ID NO: 8962 - DNA, 33 bp, homo sapien
ccagctttacctttaaygaaacagaaattttaa

SEQ ID NO: 8963 - DNA, 33 bp, homo sapien
ctcccccgtgtgcctgyaattggagggatgtgg

SEQ ID NO: 8964 - DNA, 33 bp, homo sapien
tcacatatatgatctcrcttgttcctcataaca

SEQ ID NO: 8965 - DNA, 33 bp, homo sapien
agggacttctcagtctscatagttatatgagcc

SEQ ID NO: 8966 - DNA, 33 bp, homo sapien
aaaagggaagaatttakactcataggggtctta

SEQ ID NO: 8967 - DNA, 33 bp, homo sapien
gtagccgaagaggacartgccacagagaagcag

SEQ ID NO: 8968 - DNA, 33 bp, homo sapien
tttcgaacttggccttycaggtggagactaagt

SEQ ID NO: 8969 - DNA, 33 bp, homo sapien
tgtcctctattttgtgkcacataatgcatattt

SEQ ID NO: 8970 - DNA, 33 bp, homo sapien
cgtttatttaacttacygctaatctcaatgtct

SEQ ID NO: 8971 - DNA, 33 bp, homo sapien
aggaatagccatattgyttcactctcatttttt

SEQ ID NO: 8972 - DNA, 33 bp, homo sapien
ctttggaattcttgacytggttaagggaggatt

SEQ ID NO: 8973 - DNA, 33 bp, homo sapien
attgtattgcttcaccrtcaattaatgttgtgg

SEQ ID NO: 8974 - DNA, 33 bp, homo sapien
gggaaactggggtactrctatacaactgaggca

SEQ ID NO: 8975 - DNA, 33 bp, homo sapien
ctgcttaagctgcatcygagagattctggtatg

SEQ ID NO: 8976 - DNA, 33 bp, homo sapien
gtgaacttaggaaactkaatctatcctgtggaa

SEQ ID NO: 8977 - DNA, 33 bp, homo sapien
cagacaagagcatggamtcaagaaaagggtagg

SEQ ID NO: 8978 - DNA, 33 bp, homo sapien
tctccatcaagcatcarcctttaggtactccat

SEQ ID NO: 8979 - DNA, 33 bp, homo sapien
tacaaattctatgttgycatactcccataacgt

SEQ ID NO: 8980 - DNA, 33 bp, homo sapien
ttccctcaggtttgctstaaatacacccaatat

SEQ ID NO: 8981 - DNA, 33 bp, homo sapien
ctaggcaaaaatttaaraaaacattctagtctc

SEQ ID NO: 8982 - DNA, 33 bp, homo sapien
atgcttgttaccccggratatgctgtgttattt

SEQ ID NO: 8983 - DNA, 33 bp, homo sapien
aaattcaaagacacggmggtatcagaaatacaa

SEQ ID NO: 8984 - DNA, 33 bp, homo sapien
tctatgatttctttccrcaatgtttgtagtttt

SEQ ID NO: 8985 - DNA, 33 bp, homo sapien
tctaagtatagttgacrtaaccttggcagccag

SEQ ID NO: 8986 - DNA, 33 bp, homo sapien
tattatcaaagtcataygtgtagagaagagtcc

SEQ ID NO: 8987 - DNA, 33 bp, homo sapien
aaggacataaggatagytgtcagtggtcctgaa

SEQ ID NO: 8988 - DNA, 33 bp, homo sapien
gttgtggcttatttcaycactgtactgaatctc

SEQ ID NO: 8989 - DNA, 33 bp, homo sapien
catgaaagggaaggtgstactgacatgtgctac

SEQ ID NO: 8990 - DNA, 33 bp, homo sapien
ccagcaggcaaaaaaargagtcatgttcttggc

SEQ ID NO: 8991 - DNA, 33 bp, homo sapien
ccaagattgcacctctrcactatagcctgggtg

SEQ ID NO: 8992 - DNA, 33 bp, homo sapien
agggtgattgagagaakgctggatacactggag

SEQ ID NO: 8993 - DNA, 33 bp, homo sapien
tatcttaacttgaacaygactcattttgtgaat

SEQ ID NO: 8994 - DNA, 33 bp, homo sapien
aaatgagaaaatcttgrtatgctaaatgagtac

SEQ ID NO: 8995 - DNA, 33 bp, homo sapien
tctttaaaaatacccarattgttcaaaccacca

SEQ ID NO: 8996 - DNA, 33 bp, homo sapien
aagtctggtcaaactcyttccttttggtgatgt

SEQ ID NO: 8997 - DNA, 33 bp, homo sapien
tgtgtatctgtaatccyttgtatcacattgagc

SEQ ID NO: 8998 - DNA, 33 bp, homo sapien
cagtgagaggtaaaaaygagccactcttctccc

SEQ ID NO: 8999 - DNA, 33 bp, homo sapien
ttctgccgctattgctrttcattctggaattga

SEQ ID NO: 9000 - DNA, 33 bp, homo sapien
aggaaagcattttaatycctatcaagagacaga

SEQ ID NO: 9001 - DNA, 33 bp, homo sapien
tttggcttcaattcgayggttagttattcagcc

SEQ ID NO: 9002 - DNA, 33 bp, homo sapien
aagacataactaaattyagagaagagctgaagg

SEQ ID NO: 9003 - DNA, 33 bp, homo sapien
gttcctataattggatrgataagacaggatgta

SEQ ID NO: 9004 - DNA, 33 bp, homo sapien
aggaggccgttttcttytggtaggttggtttct

SEQ ID NO: 9005 - DNA, 33 bp, homo sapien
cccaattctatacccasttctttacctcaccac

SEQ ID NO: 9006 - DNA, 33 bp, homo sapien
ggctttgtaggaggaaygagctggaaataaatg

SEQ ID NO: 9007 - DNA, 33 bp, homo sapien
gaacaaaaacagtgccrtgttactcaataagtt

SEQ ID NO: 9008 - DNA, 33 bp, homo sapien
caagataattcaatgaragaaagaataatcttt

SEQ ID NO: 9009 - DNA, 33 bp, homo sapien
taacaagggtcataaamaagattcaagtaagat

SEQ ID NO: 9010 - DNA, 33 bp, homo sapien
attcaaaatatgcaaakaactcttacaagtcaa

SEQ ID NO: 9011 - DNA, 33 bp, homo sapien
tcagcttcttagatgtmcttagggcatcctgct

SEQ ID NO: 9012 - DNA, 33 bp, homo sapien
aaaatgcagtatgcacraagggcaataaagcaa

SEQ ID NO: 9013 - DNA, 33 bp, homo sapien
ctggttctgtttaaccrtacctaaaaatgccat

SEQ ID NO: 9014 - DNA, 33 bp, homo sapien
gcatggccagcaagggmagtgttatacgctcac

SEQ ID NO: 9015 - DNA, 33 bp, homo sapien
tatctcttctttgtagwtgggagaccctaagaa

SEQ ID NO: 9016 - DNA, 33 bp, homo sapien
taccatctgacatggcrtttgcacatttggaca

SEQ ID NO: 9017 - DNA, 33 bp, homo sapien
ggtgtgtttgaggttaytgcacttgcattttgt

SEQ ID NO: 9018 - DNA, 33 bp, homo sapien
tttggaaggccatttgrcataacaaaaactaga

SEQ ID NO: 9019 - DNA, 33 bp, homo sapien
ctatccaacaaaacacrgtggctcagtagtgca

SEQ ID NO: 9020 - DNA, 33 bp, homo sapien
gatcaggcatttccagytgactcacagtgggct

SEQ ID NO: 9021 - DNA, 33 bp, homo sapien
ttattggagttcttgcrtttaagcctgtttcac

SEQ ID NO: 9022 - DNA, 33 bp, homo sapien
ctaactcaaggaattgmaagaaataatgtgatt

SEQ ID NO: 9023 - DNA, 33 bp, homo sapien
caatccttcatggataycaacggacaagggcat

SEQ ID NO: 9024 - DNA, 33 bp, homo sapien
aggtgggcatagctacygtgaagggcagcagag

SEQ ID NO: 9025 - DNA, 33 bp, homo sapien
ggaaaggggagttgccrttttattggtgccact

SEQ ID NO: 9026 - DNA, 33 bp, homo sapien
ccttggaaccagtctgrataggaggatacagga

SEQ ID NO: 9027 - DNA, 33 bp, homo sapien
gtagatatcagttaatyggtaatatctcctaga

SEQ ID NO: 9028 - DNA, 33 bp, homo sapien
ctccttcttgcagttayttcctaacgctagatg

SEQ ID NO: 9029 - DNA, 33 bp, homo sapien
ttattttacagagtagscttgtgtttactttga

SEQ ID NO: 9030 - DNA, 33 bp, homo sapien
aaaccatatctattacrttacccagcatagtaa

SEQ ID NO: 9031 - DNA, 33 bp, homo sapien
tctgcgtgtccttgggmaacttgctgtgtgacc

SEQ ID NO: 9032 - DNA, 33 bp, homo sapien
ctttctaaatacttgargacctgttatgtgcta

SEQ ID NO: 9033 - DNA, 33 bp, homo sapien
ctcccacttgctcagaycagaaactctgaattt

SEQ ID NO: 9034 - DNA, 33 bp, homo sapien
gaatgtacggtagacaytgatgtgttatatgat

SEQ ID NO: 9035 - DNA, 33 bp, homo sapien
ccctgcaaaatgtgtartccagcatcctaggct

SEQ ID NO: 9036 - DNA, 33 bp, homo sapien
atgaataaacaaatackaaatcttaacaaagaa

SEQ ID NO: 9037 - DNA, 33 bp, homo sapien
cctttcagctgttagtrtgatatgctgatatga

SEQ ID NO: 9038 - DNA, 33 bp, homo sapien
gacagacagagaaagakaaaatgtgacagtcta

SEQ ID NO: 9039 - DNA, 33 bp, homo sapien
acacttgatttggaaayactgatggcctatctt

SEQ ID NO: 9040 - DNA, 33 bp, homo sapien
actaaaattcaaaaatyagtcgggtgcagtgac

SEQ ID NO: 9041 - DNA, 33 bp, homo sapien
tatagattcccgttgayataagctggaaatgtc

SEQ ID NO: 9042 - DNA, 33 bp, homo sapien
gccaaacccatgcaaargaggaactgcaaaatt

SEQ ID NO: 9043 - DNA, 33 bp, homo sapien
gagtggcatggttgtgsttgaatgatagaggat

SEQ ID NO: 9044 - DNA, 33 bp, homo sapien
tcagttcttttagcatrtgtgaaaaacagaaac

SEQ ID NO: 9045 - DNA, 33 bp, homo sapien
tcctccaaagggctaasagtcaaaccatggtat

SEQ ID NO: 9046 - DNA, 33 bp, homo sapien
ggattttgtgtttcctyggatacagaaataagt

SEQ ID NO: 9047 - DNA, 33 bp, homo sapien
ttgtagaccagaagagyaaaccagcctaatctt

SEQ ID NO: 9048 - DNA, 33 bp, homo sapien
cctgggtctaaattctyctgaaatcctttatca

SEQ ID NO: 9049 - DNA, 33 bp, homo sapien
gcagctcagtggtgctyccagaggctcgggctc

SEQ ID NO: 9050 - DNA, 33 bp, homo sapien
taagcagtaagtcattyatttggacaatagata

SEQ ID NO: 9051 - DNA, 33 bp, homo sapien
attgttctgcagcctaratacttgaaagcaatt

SEQ ID NO: 9052 - DNA, 33 bp, homo sapien
gccacactgaaaaccaraactaagaaatacttt

SEQ ID NO: 9053 - DNA, 33 bp, homo sapien
ctcgatgccactaatcrttagggaaatgcaagt

SEQ ID NO: 9054 - DNA, 33 bp, homo sapien
cccactgcataatccartcacaaaagaaagagt

SEQ ID NO: 9055 - DNA, 33 bp, homo sapien
caggaacattcaaattyaggaaacattcaaatt

SEQ ID NO: 9056 - DNA, 33 bp, homo sapien
cagaggtgactgacttygtttgcagcagagcat

SEQ ID NO: 9057 - DNA, 33 bp, homo sapien
aatctcactaaaattcragaatattcaaaattt

SEQ ID NO: 9058 - DNA, 33 bp, homo sapien
ttttaagaaaagcaacrtaagcaacaaaagctt

SEQ ID NO: 9059 - DNA, 33 bp, homo sapien
aatggctttggtctagygtcctatagagcttgg

SEQ ID NO: 9060 - DNA, 33 bp, homo sapien
atctcctactactcccrtcttgctcactctgct

SEQ ID NO: 9061 - DNA, 33 bp, homo sapien
tggattataaagagacrcgtaggctaagaaaat

SEQ ID NO: 9062 - DNA, 33 bp, homo sapien
aaggggtcaggagttcsgagagacacccaggct

SEQ ID NO: 9063 - DNA, 33 bp, homo sapien
agggaggttggttatargcaatgcatgaaggct

SEQ ID NO: 9064 - DNA, 33 bp, homo sapien
tactgggcctaatcctygttattggcacattga

SEQ ID NO: 9065 - DNA, 33 bp, homo sapien
agttcagcgaaaacttstaaggatggaattcag

SEQ ID NO: 9066 - DNA, 33 bp, homo sapien
aattatctaactaaggkctatttgtgactcagc

SEQ ID NO: 9067 - DNA, 33 bp, homo sapien
aaaactatttcatttawttgaatcaccggtttc

SEQ ID NO: 9068 - DNA, 33 bp, homo sapien
attggacagcaagagaygaagttgagggatgaa

SEQ ID NO: 9069 - DNA, 33 bp, homo sapien
aaagaggcctctagcarttgccaacaaatttca

SEQ ID NO: 9070 - DNA, 33 bp, homo sapien
cttatgcttccataatkcaggaagaaaccttcg

SEQ ID NO: 9071 - DNA, 33 bp, homo sapien
gctcacttaacatggcyataattctctccccat

SEQ ID NO: 9072 - DNA, 33 bp, homo sapien
aagacaggcaggagctygaaaggagaaggagag

SEQ ID NO: 9073 - DNA, 33 bp, homo sapien
tctctttccatcaaacrtaataaatccacagct

SEQ ID NO: 9074 - DNA, 33 bp, homo sapien
gggcttctgttttaacsattgaccttcatctct

SEQ ID NO: 9075 - DNA, 33 bp, homo sapien
aagcccgtctatggacwcaaaactggtgtgata

SEQ ID NO: 9076 - DNA, 33 bp, homo sapien
acagagaacaatccatytcatggagactagtac

SEQ ID NO: 9077 - DNA, 33 bp, homo sapien
ggcagatacaagattartatgcaaaaatcaatt

SEQ ID NO: 9078 - DNA, 33 bp, homo sapien
aataccatcaaaatctyggccagctttcacatc

SEQ ID NO: 9079 - DNA, 33 bp, homo sapien
tgcccttcatacaaaamcgaaactgctatggta

SEQ ID NO: 9080 - DNA, 33 bp, homo sapien
cttaaaaagaattaaaytgatggtaagaaaatg

SEQ ID NO: 9081 - DNA, 33 bp, homo sapien
accactgcttagcatartaattggcatttgtta

SEQ ID NO: 9082 - DNA, 33 bp, homo sapien
agttttccaaaaggtcrtatcatactgcaagca

SEQ ID NO: 9083 - DNA, 33 bp, homo sapien
cacctcagagccttccygagcaggtgaacagat

SEQ ID NO: 9084 - DNA, 33 bp, homo sapien
cagctccttctttctgygccatcctattgtttc

SEQ ID NO: 9085 - DNA, 33 bp, homo sapien
aaagcaatgaaggtacmaaaatgacctgtgatt

SEQ ID NO: 9086 - DNA, 33 bp, homo sapien
caaactgagccacaaaygcctacaactaatggg

SEQ ID NO: 9087 - DNA, 33 bp, homo sapien
gtggcagtgtaaacccmtgtagactggaggaga

SEQ ID NO: 9088 - DNA, 33 bp, homo sapien
gcccaaggtggagtacrgcctgggtatccctgc

SEQ ID NO: 9089 - DNA, 33 bp, homo sapien
cagaggctggcaacagrttgtgaacatgccagt

SEQ ID NO: 9090 - DNA, 33 bp, homo sapien
gtcacaggacaaacacygaaaagaatagagtag

SEQ ID NO: 9091 - DNA, 33 bp, homo sapien
ctttatttctttctctyggctcattaccctgcc

SEQ ID NO: 9092 - DNA, 33 bp, homo sapien
taggtaagaggtagagkttggaaggattggaag

SEQ ID NO: 9093 - DNA, 33 bp, homo sapien
ctgagatgcctttgagraaaatggtaacagcag

SEQ ID NO: 9094 - DNA, 33 bp, homo sapien
aattatgctgaccaagrtgaacactttgaggag

SEQ ID NO: 9095 - DNA, 33 bp, homo sapien
tcagaaatagaaaaaaytgaattgccattatta

SEQ ID NO: 9096 - DNA, 33 bp, homo sapien
cccatcagccttacaascttatctcgttggatt

SEQ ID NO: 9097 - DNA, 33 bp, homo sapien
ttgagataatcagatgktttttgcttttaattc

SEQ ID NO: 9098 - DNA, 33 bp, homo sapien
cacctgactgtgctaamactagagcctatttct

SEQ ID NO: 9099 - DNA, 33 bp, homo sapien
aaagcggggactccagscttataaaatatgatt

SEQ ID NO: 9100 - DNA, 33 bp, homo sapien
gggaagggaatgaaccrgtgttttccatttgcc

SEQ ID NO: 9101 - DNA, 33 bp, homo sapien
cttacaagagaaatgcmaggagagtcggaagaa

SEQ ID NO: 9102 - DNA, 33 bp, homo sapien
cccaccatatgcaccartacttttaacggagcc

SEQ ID NO: 9103 - DNA, 33 bp, homo sapien
cacttcctctgcatcaytcttaaccctttgcca

SEQ ID NO: 9104 - DNA, 33 bp, homo sapien
gagctaagcattgtgcygcaacagctgttagca

SEQ ID NO: 9105 - DNA, 33 bp, homo sapien
gtttggggcatcgtgamtctccctagtgatcag

SEQ ID NO: 9106 - DNA, 33 bp, homo sapien
agatccccaagtgaccratttgcacagtaaggt

SEQ ID NO: 9107 - DNA, 33 bp, homo sapien
atcatggtcaagttccrgtgagggccctcttct

SEQ ID NO: 9108 - DNA, 33 bp, homo sapien
ttgatggtttcgagttmgagagaagagagtttg

SEQ ID NO: 9109 - DNA, 33 bp, homo sapien
accaatccaaaaatagrccctaggttttctctt

SEQ ID NO: 9110 - DNA, 33 bp, homo sapien
caacttggtacctccaytgaattaaagatttaa

SEQ ID NO: 9111 - DNA, 33 bp, homo sapien
gtccccaggactcttaygggtcacacaaaacta

SEQ ID NO: 9112 - DNA, 33 bp, homo sapien
ccagcagcaacacccargtttagcagcagtact

SEQ ID NO: 9113 - DNA, 33 bp, homo sapien
tggatcacgctcatttkttcaaagcacagcagc

SEQ ID NO: 9114 - DNA, 33 bp, homo sapien
aaccaaagagcttagtyggatttgagggaaaag

SEQ ID NO: 9115 - DNA, 33 bp, homo sapien
gcatcatcctaagcaamattccctaagttttcc

SEQ ID NO: 9116 - DNA, 33 bp, homo sapien
aaagtaataactaacayaccggaacgcaaaaag

SEQ ID NO: 9117 - DNA, 33 bp, homo sapien
tcttgttcattcaatawtgcctgtttttgacca

SEQ ID NO: 9118 - DNA, 33 bp, homo sapien
aaatgggtgtgcaacaytgggttttgctttaaa

SEQ ID NO: 9119 - DNA, 33 bp, homo sapien
attttccatttcttttrtacatcataggtagcc

SEQ ID NO: 9120 - DNA, 33 bp, homo sapien
cattttcatttgtctcraggaatttttaaatgt

SEQ ID NO: 9121 - DNA, 33 bp, homo sapien
tcatagcagtggtcatytcttggttccatataa

SEQ ID NO: 9122 - DNA, 33 bp, homo sapien
actgagtcttctctccrgcagaaatgatcatta

SEQ ID NO: 9123 - DNA, 33 bp, homo sapien
aagtaattgttcttatygcaccttattgacaat

SEQ ID NO: 9124 - DNA, 33 bp, homo sapien
ggatccacgccaatgcrtttaccactctggaac

SEQ ID NO: 9125 - DNA, 33 bp, homo sapien
atctgtttacagcctgrtatactgaatatttta

SEQ ID NO: 9126 - DNA, 33 bp, homo sapien
gggaggaccaacacagrtaagtgcttcccaacc

SEQ ID NO: 9127 - DNA, 33 bp, homo sapien
gttgaacaaggaagatwatcttttttaagcttt

SEQ ID NO: 9128 - DNA, 33 bp, homo sapien
ggggtgatgggtaaacytaacaagaatcatctt

SEQ ID NO: 9129 - DNA, 33 bp, homo sapien
acgtttgaagtgaagckatactgaccataaaaa

SEQ ID NO: 9130 - DNA, 33 bp, homo sapien
ttcagcagtttatgtgygaggtatttaggtttg

SEQ ID NO: 9131 - DNA, 33 bp, homo sapien
tagtcttggctgtgctmtgaaacctggaagtcg

SEQ ID NO: 9132 - DNA, 33 bp, homo sapien
gccttctcgcttttctyggacacaccacactct

SEQ ID NO: 9133 - DNA, 33 bp, homo sapien
ttttatcctgagatatwcactgttttgcctttg

SEQ ID NO: 9134 - DNA, 33 bp, homo sapien
aagacaaactaacagaraaattggcaaaggatg

SEQ ID NO: 9135 - DNA, 33 bp, homo sapien
cctctccaaaaactaawgtaggaattgaaaagc

SEQ ID NO: 9136 - DNA, 33 bp, homo sapien
tgaaatagtgtatgtgyaacctaaaaatctgaa

SEQ ID NO: 9137 - DNA, 33 bp, homo sapien
gtactggtacaatacaracacataaatcaatgg

SEQ ID NO: 9138 - DNA, 33 bp, homo sapien
agtttgttttttagtcrcttgttaaaaaggtgc

SEQ ID NO: 9139 - DNA, 33 bp, homo sapien
tccttgatttctcttgygtctgcagtcatgcat

SEQ ID NO: 9140 - DNA, 33 bp, homo sapien
tgaaagcagaaaacagrtatcagccttgggaaa

SEQ ID NO: 9141 - DNA, 33 bp, homo sapien
gatagatgttgagcccrggtagcttgggattgt

SEQ ID NO: 9142 - DNA, 33 bp, homo sapien
acagtctgctgagctcwtgttgtcacaagcaga

SEQ ID NO: 9143 - DNA, 33 bp, homo sapien
aaatggcacatctgaamtttacataagaaatgg

SEQ ID NO: 9144 - DNA, 33 bp, homo sapien
atctctaactggtgatraagcatcatgaaattc

SEQ ID NO: 9145 - DNA, 33 bp, homo sapien
gtgttcctttagggcargcaccatctctgtttc

SEQ ID NO: 9146 - DNA, 33 bp, homo sapien
ttggaatgagaattacwtcatctgcttctctca

SEQ ID NO: 9147 - DNA, 33 bp, homo sapien
atgacttgtttatgttyctattgcctgtctccc

SEQ ID NO: 9148 - DNA, 33 bp, homo sapien
ctccaaaaatccatagkcccagtctaatcatga

SEQ ID NO: 9149 - DNA, 33 bp, homo sapien
gatacttagtccatgaytttcccttgcttggat

SEQ ID NO: 9150 - DNA, 33 bp, homo sapien
ggtatgatcaacgatayggcagaagtatgcaca

SEQ ID NO: 9151 - DNA, 33 bp, homo sapien
atttggagcaattatasatagtactgcattttt

SEQ ID NO: 9152 - DNA, 33 bp, homo sapien
tttatacaagtgtgttytttcagctcacatttc

SEQ ID NO: 9153 - DNA, 33 bp, homo sapien
aatacatgcgaagtttycttaagacagacaggt

SEQ ID NO: 9154 - DNA, 33 bp, homo sapien
gtgtctatacagcaggwtaagcaataaagctcc

SEQ ID NO: 9155 - DNA, 33 bp, homo sapien
cccagagcaaacagatkcaggatgatccgcact

SEQ ID NO: 9156 - DNA, 33 bp, homo sapien
gacatcagaaaacaccmtttatagtcatgccac

SEQ ID NO: 9157 - DNA, 33 bp, homo sapien
cctttcccagtgatcayactatttcacctccta

SEQ ID NO: 9158 - DNA, 33 bp, homo sapien
cagacctagattgaccygttagctctcccactt

SEQ ID NO: 9159 - DNA, 33 bp, homo sapien
caacgaacaatgtcaartaacaatgatgataga

SEQ ID NO: 9160 - DNA, 33 bp, homo sapien
gcccttatccaaaggasgtgttaggctaattgt

SEQ ID NO: 9161 - DNA, 33 bp, homo sapien
gaactaaaattatggaraaccagacacgagttc

SEQ ID NO: 9162 - DNA, 33 bp, homo sapien
acttcttatttacaagygattagtttgctgtga

SEQ ID NO: 9163 - DNA, 33 bp, homo sapien
cactgctttcagagctkcatttacctcccattg

SEQ ID NO: 9164 - DNA, 33 bp, homo sapien
gtttggggctcaataakgtaatggttcaaaaga

SEQ ID NO: 9165 - DNA, 33 bp, homo sapien
actaaaaaaatttaccracttctaggccatgaa

SEQ ID NO: 9166 - DNA, 33 bp, homo sapien
aaaaataagtgcacacragacattcaaatactt

SEQ ID NO: 9167 - DNA, 33 bp, homo sapien
taattttggattgtatsttagacattgtggtgg

SEQ ID NO: 9168 - DNA, 33 bp, homo sapien
tgttgctaaggaattamtgcaggcactgagaaa

SEQ ID NO: 9169 - DNA, 33 bp, homo sapien
gggtttcattgagcaartcatcaaactccccaa

SEQ ID NO: 9170 - DNA, 33 bp, homo sapien
tacaattcatacctagmgagctcagtaaccatg

SEQ ID NO: 9171 - DNA, 33 bp, homo sapien
aagggctcttcgaaaakattaagtgcatgactc

SEQ ID NO: 9172 - DNA, 33 bp, homo sapien
ccctggataactctctrtaactccttcaagtgg

SEQ ID NO: 9173 - DNA, 33 bp, homo sapien
ccccaggcgccattacrccatatttgaattatg

SEQ ID NO: 9174 - DNA, 33 bp, homo sapien
accacagaccttcacayttatacagcaatgagg

SEQ ID NO: 9175 - DNA, 33 bp, homo sapien
ggctcagacaagttacytaacatctctgctgat

SEQ ID NO: 9176 - DNA, 33 bp, homo sapien
ctgccttctggaaaaaygtcaccctgccgcctt

SEQ ID NO: 9177 - DNA, 33 bp, homo sapien
taatcaaactaaagaastcctacatagcaaaag

SEQ ID NO: 9178 - DNA, 33 bp, homo sapien
aacgggataaaagatakgaagagacactacacc

SEQ ID NO: 9179 - DNA, 33 bp, homo sapien
tttcttcatacaaccasagcagtcctaaaacag

SEQ ID NO: 9180 - DNA, 33 bp, homo sapien
gggagtctgctcttaargctttctgccttttct

SEQ ID NO: 9181 - DNA, 33 bp, homo sapien
tgcccagagagaaatamactagtccatgccccc

SEQ ID NO: 9182 - DNA, 33 bp, homo sapien
agtgcatactggaatgsataagattaatgaagc

SEQ ID NO: 9183 - DNA, 33 bp, homo sapien
attgactgtttattccyaattgcactggacaat

SEQ ID NO: 9184 - DNA, 33 bp, homo sapien
tctcagattctgtttayggagaacagaagccaa

SEQ ID NO: 9185 - DNA, 33 bp, homo sapien
gaggctggagtgtaatragcaagagagagcgat

SEQ ID NO: 9186 - DNA, 33 bp, homo sapien
gtttccaaatggaccarggaaaacaaacgttta

SEQ ID NO: 9187 - DNA, 33 bp, homo sapien
tgttagacatactgttyggatctgccaaagtct

SEQ ID NO: 9188 - DNA, 33 bp, homo sapien
ctgtgatgctgaggatygaaaacagaactaaca

SEQ ID NO: 9189 - DNA, 33 bp, homo sapien
aagaatgtttattaggycagaggatcaaggtta

SEQ ID NO: 9190 - DNA, 33 bp, homo sapien
agttccagaagcattgycagtgctaagagtgaa

SEQ ID NO: 9191 - DNA, 33 bp, homo sapien
gataaggcaaggtttayggccctgaggatgccg

SEQ ID NO: 9192 - DNA, 33 bp, homo sapien
aagtcctagtcaaagtrgttgggatggtgctga

SEQ ID NO: 9193 - DNA, 33 bp, homo sapien
acctcaataaattctayggcacatcagtctgtg

SEQ ID NO: 9194 - DNA, 33 bp, homo sapien
tcaaacgaaggtcagcygaagaagtagaagaaa

SEQ ID NO: 9195 - DNA, 33 bp, homo sapien
atagcctttcattgttmttctccagtgcattga

SEQ ID NO: 9196 - DNA, 33 bp, homo sapien
ggaggcctaattcccaygggtaaacacttatgt

SEQ ID NO: 9197 - DNA, 33 bp, homo sapien
aatttaagcaaatgaayatctttacctttatgc

SEQ ID NO: 9198 - DNA, 33 bp, homo sapien
cctcacagaatttacaytggagcctaagtaaca

SEQ ID NO: 9199 - DNA, 33 bp, homo sapien
tttggtttctcttctaygactaatcctacactt

SEQ ID NO: 9200 - DNA, 33 bp, homo sapien
cagtctgtagccaaagrcccgcgagctcctggc

SEQ ID NO: 9201 - DNA, 33 bp, homo sapien
gccatggtgatttgctrtatagatcaacctgtc

SEQ ID NO: 9202 - DNA, 33 bp, homo sapien
gattcctttccatagtygtcatgagctaacaca

SEQ ID NO: 9203 - DNA, 33 bp, homo sapien
cctgataccaaaacccraaagagacataacaaa

SEQ ID NO: 9204 - DNA, 33 bp, homo sapien
tgacaaaaagtggcgayggtatgactcaggctg

SEQ ID NO: 9205 - DNA, 33 bp, homo sapien
ctagaagcacacatagytgtttcactgctaata

SEQ ID NO: 9206 - DNA, 33 bp, homo sapien
accttgaaaataacagyggttaaagggcaggtg

SEQ ID NO: 9207 - DNA, 33 bp, homo sapien
tgaactgcaatagcatraaccagtacacattcc

SEQ ID NO: 9208 - DNA, 33 bp, homo sapien
tgaggagttcagttttkgtcatgttcaatttga

SEQ ID NO: 9209 - DNA, 33 bp, homo sapien
ggcactatgactaaaamaatgcacatcccctaa

SEQ ID NO: 9210 - DNA, 33 bp, homo sapien
gtttacagaacgcatakaacagttgtgaggctg

SEQ ID NO: 9211 - DNA, 33 bp, homo sapien
ctatacccttaaagacyctttctgctccaagat

SEQ ID NO: 9212 - DNA, 33 bp, homo sapien
accagaaatcaggctayggttccagctacacat

SEQ ID NO: 9213 - DNA, 33 bp, homo sapien
acatgatcaaaactgcrtgatcttctgctgagc

SEQ ID NO: 9214 - DNA, 33 bp, homo sapien
gaaccattcttttgatkgcactgattggaacag

SEQ ID NO: 9215 - DNA, 33 bp, homo sapien
agtcttcagtgtccaayctctttgctcattaaa

SEQ ID NO: 9216 - DNA, 33 bp, homo sapien
tgtcttgtgtggataakttttcaatttggtgtt

SEQ ID NO: 9217 - DNA, 33 bp, homo sapien
gacttcaaacgatactrtaaggcactagttact

SEQ ID NO: 9218 - DNA, 33 bp, homo sapien
ttcggagtgtttgttcstcacctaacattccag

SEQ ID NO: 9219 - DNA, 33 bp, homo sapien
tgaagttctgatgaggrcatcaagctgctttta

SEQ ID NO: 9220 - DNA, 33 bp, homo sapien
tcatttgttctctggcwatgtgaatattcctca

SEQ ID NO: 9221 - DNA, 33 bp, homo sapien
tcaggctaagctgttawttgatgtgaacatcag

SEQ ID NO: 9222 - DNA, 33 bp, homo sapien
tttggataggtaaatakagtttgcatgtggaat

SEQ ID NO: 9223 - DNA, 33 bp, homo sapien
ttgcaacctgacgcctstgctttccttccagat

SEQ ID NO: 9224 - DNA, 33 bp, homo sapien
agactttatttttccgyattgttttctagcccc

SEQ ID NO: 9225 - DNA, 33 bp, homo sapien
ttcacacacaggagacrtttgagtccaattctc

SEQ ID NO: 9226 - DNA, 33 bp, homo sapien
cctggatctggagtgaytcctcacatcgcattt

SEQ ID NO: 9227 - DNA, 33 bp, homo sapien
cttttcaatcagggcasgatctgtctccaattt

SEQ ID NO: 9228 - DNA, 33 bp, homo sapien
ggcaacatagctataaytctgggagtgactcct

SEQ ID NO: 9229 - DNA, 33 bp, homo sapien
ggacagaggatttttcyttgcactttatcttat

SEQ ID NO: 9230 - DNA, 33 bp, homo sapien
tactgttggccgtagckttaagtgtcagaagct

SEQ ID NO: 9231 - DNA, 33 bp, homo sapien
ataggcatgggcagaamcttaatgactaaaaca

SEQ ID NO: 9232 - DNA, 33 bp, homo sapien
tcaatcctaaaatttartaaggcaaatgtttgg

SEQ ID NO: 9233 - DNA, 33 bp, homo sapien
tccttggtgcttatgcwtggagagagatggaga

SEQ ID NO: 9234 - DNA, 33 bp, homo sapien
agttagccgttttcatsaatgatcttagctaga

SEQ ID NO: 9235 - DNA, 33 bp, homo sapien
tggactacaagaaattwtgaagctatttcaggc

SEQ ID NO: 9236 - DNA, 33 bp, homo sapien
ctgtatcacactgtctygactaatgtaccttta

SEQ ID NO: 9237 - DNA, 33 bp, homo sapien
gctttccccattacttkttgcgattaccacgat

SEQ ID NO: 9238 - DNA, 33 bp, homo sapien
aaagcacacttaagtayaccattgacgccatga

SEQ ID NO: 9239 - DNA, 33 bp, homo sapien
gctcttccacatttttwgaatcacttaacttct

SEQ ID NO: 9240 - DNA, 33 bp, homo sapien
tcccagtcagctgtcayttcggaaaccatctga

SEQ ID NO: 9241 - DNA, 33 bp, homo sapien
ctaggtgtgtctcagtygaatggccaaatcatt

SEQ ID NO: 9242 - DNA, 33 bp, homo sapien
ccaacctctgcctgttwcccatttgcaaagttg

SEQ ID NO: 9243 - DNA, 33 bp, homo sapien
cgtcaaccagggctgckctaattagattgcttc

SEQ ID NO: 9244 - DNA, 33 bp, homo sapien
agctatgaagaacatawtataaagcagtatgag

SEQ ID NO: 9245 - DNA, 33 bp, homo sapien
accagggcttggctagrtcacagctctgtggct

SEQ ID NO: 9246 - DNA, 33 bp, homo sapien
cgtaaagcaagacaggraaatacagtttgggat

SEQ ID NO: 9247 - DNA, 33 bp, homo sapien
gcagacaacccacaggmctaaacttgccatggg

SEQ ID NO: 9248 - DNA, 33 bp, homo sapien
aaatacatatatttgawaaaagacttcatatcc

SEQ ID NO: 9249 - DNA, 33 bp, homo sapien
aaaggctaaaccgatayagggaagctctcttgt

SEQ ID NO: 9250 - DNA, 33 bp, homo sapien
gctgttttcttattgasgctcaaaaattcttta

SEQ ID NO: 9251 - DNA, 33 bp, homo sapien
taggagacaaaggagawaggtccttgatttaga

SEQ ID NO: 9252 - DNA, 33 bp, homo sapien
ctgggattgattctggratgaaattaagtaact

SEQ ID NO: 9253 - DNA, 33 bp, homo sapien
tagcaaggctcaatgckgaaattcatggtttta

SEQ ID NO: 9254 - DNA, 33 bp, homo sapien
gtcttcacatttttcasatttgattttgccatc

SEQ ID NO: 9255 - DNA, 33 bp, homo sapien
tgttactataattgtastgaggaatcattgcag

SEQ ID NO: 9256 - DNA, 33 bp, homo sapien
tttagcatagtcttctraagtagtaggagcata

SEQ ID NO: 9257 - DNA, 33 bp, homo sapien
cttgcctgttatatagmgcaatcatgaatcatc

SEQ ID NO: 9258 - DNA, 33 bp, homo sapien
ttttgttactacattgmgatacaccagtctaat

SEQ ID NO: 9259 - DNA, 33 bp, homo sapien
agttcctgaaaatgttyctatctactttttctg

SEQ ID NO: 9260 - DNA, 33 bp, homo sapien
agaacaactatgatgcytcagcggtgaccattc

SEQ ID NO: 9261 - DNA, 33 bp, homo sapien
aagctaatgtagctccwtctttaatgatcacac

SEQ ID NO: 9262 - DNA, 33 bp, homo sapien
ttacatttcctgcagayaagactgcttctggag

SEQ ID NO: 9263 - DNA, 33 bp, homo sapien
tgaacaaaaatgaagaytgccacatcagttgac

SEQ ID NO: 9264 - DNA, 33 bp, homo sapien
ccatacttaccatgcartacttttccaataatt

SEQ ID NO: 9265 - DNA, 33 bp, homo sapien
gcttaaggcattcttamatcacaaacaatagca

SEQ ID NO: 9266 - DNA, 33 bp, homo sapien
ccattgtatgggcagcstataaaagctggtgtt

SEQ ID NO: 9267 - DNA, 33 bp, homo sapien
aggggactctataaaaycctgtaaaatcttgac

SEQ ID NO: 9268 - DNA, 33 bp, homo sapien
tcttcagattgtcagawaagtagctttagccat

SEQ ID NO: 9269 - DNA, 33 bp, homo sapien
cctgttctcactcttartagaaactgctgctaa

SEQ ID NO: 9270 - DNA, 33 bp, homo sapien
tttgggatttggtagayagataactcagctttc

SEQ ID NO: 9271 - DNA, 33 bp, homo sapien
aaaaaaaggagggactygccacttcttctgtct

SEQ ID NO: 9272 - DNA, 33 bp, homo sapien
ggtcagactcaagataygtttgaccatagaacc

SEQ ID NO: 9273 - DNA, 33 bp, homo sapien
acaggcctcgatttacytgtggtttccctttct

SEQ ID NO: 9274 - DNA, 33 bp, homo sapien
gtctgcaaacctcattsttcctggatgcggcac

SEQ ID NO: 9275 - DNA, 33 bp, homo sapien
tggaaacattgagccaycatttaagaaatctgg

SEQ ID NO: 9276 - DNA, 33 bp, homo sapien
aagaaattgtgaatgcrtagaaattaatcagag

SEQ ID NO: 9277 - DNA, 33 bp, homo sapien
tttaccagatttgtgaytgtgaattatttatta

SEQ ID NO: 9278 - DNA, 33 bp, homo sapien
ccaatagagacttaaawagagcaacagtagcta

SEQ ID NO: 9279 - DNA, 33 bp, homo sapien
ccattctgtacctgcaygtgactttgaggccct

SEQ ID NO: 9280 - DNA, 33 bp, homo sapien
ctctatgagcacatttyattgcaagactgggca

SEQ ID NO: 9281 - DNA, 33 bp, homo sapien
caggctacaggttcacrtaggtcagctccacag

SEQ ID NO: 9282 - DNA, 33 bp, homo sapien
agaaaattcatatcagmacatacagatctacct

SEQ ID NO: 9283 - DNA, 33 bp, homo sapien
ctgattctcatggttaygtgaatatggactatc

SEQ ID NO: 9284 - DNA, 33 bp, homo sapien
gtaaattatgtacgcaygagataaaacctggcc

SEQ ID NO: 9285 - DNA, 33 bp, homo sapien
tgctacgccatgtaccktaggatgcttagcagc

SEQ ID NO: 9286 - DNA, 33 bp, homo sapien
atagtgtttcaatgaasttgacctttagtgcaa

SEQ ID NO: 9287 - DNA, 33 bp, homo sapien
ggttcttaaaatgccarctgacttgtgtttttc

SEQ ID NO: 9288 - DNA, 33 bp, homo sapien
atcaagtcagaggttcrtccaaggcgctcgatt

SEQ ID NO: 9289 - DNA, 33 bp, homo sapien
agatgacttcctgaatmttgcaaggtctggagc

SEQ ID NO: 9290 - DNA, 33 bp, homo sapien
tccaatccaaattatayctttgtgaatacataa

SEQ ID NO: 9291 - DNA, 33 bp, homo sapien
ataactacgaacgtttygtctttggtggctaag

SEQ ID NO: 9292 - DNA, 33 bp, homo sapien
ctgagaagggaggatcratcgcttgagcctaag

SEQ ID NO: 9293 - DNA, 33 bp, homo sapien
gtaaaagagcaacacasgattcttgcggctttg

SEQ ID NO: 9294 - DNA, 33 bp, homo sapien
ctctgtctatgctcaayaaatggaagaacaaag

SEQ ID NO: 9295 - DNA, 33 bp, homo sapien
actcctcgagaagagtrattccaagacacgtaa

SEQ ID NO: 9296 - DNA, 33 bp, homo sapien
tctttctggctcctacyagcctgctcagctgtg

SEQ ID NO: 9297 - DNA, 33 bp, homo sapien
ttagaacactgtgaaaygctgccaagaagaggt

SEQ ID NO: 9298 - DNA, 33 bp, homo sapien
gttgaatactttatcaytacacaatgcccttct

SEQ ID NO: 9299 - DNA, 33 bp, homo sapien
tctctggtactctgctytttgtactctagctga

SEQ ID NO: 9300 - DNA, 33 bp, homo sapien
cctctctccttcactcwttgtatgttacctttg

SEQ ID NO: 9301 - DNA, 33 bp, homo sapien
taagtgcactaactgarcacttgcagcatatac

SEQ ID NO: 9302 - DNA, 33 bp, homo sapien
gcaatatgagaaaatastacaatggaaaaagta

SEQ ID NO: 9303 - DNA, 33 bp, homo sapien
aagaagaaaggttctcratccagtccgtggatt

SEQ ID NO: 9304 - DNA, 33 bp, homo sapien
caattattgaggtcaamtgaactgtcagcactc

SEQ ID NO: 9305 - DNA, 33 bp, homo sapien
cagtggccctcatctcwtagctccactagacag

SEQ ID NO: 9306 - DNA, 33 bp, homo sapien
ccacagaataagtccarttgctttttcatatga

SEQ ID NO: 9307 - DNA, 33 bp, homo sapien
agactgaaataacgcawctacaaaccaaggaat

SEQ ID NO: 9308 - DNA, 33 bp, homo sapien
ttttacttagtcgatayatctcttcgtgtgact

SEQ ID NO: 9309 - DNA, 33 bp, homo sapien
gcgccactacataaaakgattcagaaagtccaa

SEQ ID NO: 9310 - DNA, 33 bp, homo sapien
tgccatacaatttcaasggcagcttcctcctgt

SEQ ID NO: 9311 - DNA, 33 bp, homo sapien
ggactgatttctaaaaytatgcaactcccatga

SEQ ID NO: 9312 - DNA, 33 bp, homo sapien
tcttgacatgttgtggygagactgaaatccaaa

SEQ ID NO: 9313 - DNA, 33 bp, homo sapien
gaggtcgcagtgaaccraaatagggccactgca

SEQ ID NO: 9314 - DNA, 33 bp, homo sapien
agttttaccaaggaagwctcagtgttgtctaag

SEQ ID NO: 9315 - DNA, 33 bp, homo sapien
gctggagtagcacactyaaatgaggaaggtgtt

SEQ ID NO: 9316 - DNA, 33 bp, homo sapien
ggaaaggagtggccagrccatagaggcagaggc

SEQ ID NO: 9317 - DNA, 33 bp, homo sapien
agtatacttactgtaayagagcttgatttcgtt

SEQ ID NO: 9318 - DNA, 33 bp, homo sapien
gatgacttgagtggatrtaacctgtgagcctca

SEQ ID NO: 9319 - DNA, 33 bp, homo sapien
aacatggatgtacaagyatctgagtacctgttt

SEQ ID NO: 9320 - DNA, 33 bp, homo sapien
gctggctggtcacagtrttaagatgtgcattct

SEQ ID NO: 9321 - DNA, 33 bp, homo sapien
cccagagctgtggtgargttcaaatgagctaat

SEQ ID NO: 9322 - DNA, 33 bp, homo sapien
agccttggctcttcttmgatgagacccaatgca

SEQ ID NO: 9323 - DNA, 33 bp, homo sapien
ccatcttttgacaccargaagtatgggaactcg

SEQ ID NO: 9324 - DNA, 33 bp, homo sapien
cttctggaggctgaaartacaagatcagggtgc

SEQ ID NO: 9325 - DNA, 33 bp, homo sapien
aaatatagatgctagarcttcactcccagagaa

SEQ ID NO: 9326 - DNA, 33 bp, homo sapien
tttacaaacgttgttarctcatttcacccttgc

SEQ ID NO: 9327 - DNA, 33 bp, homo sapien
aatcaggaactttaggratatactgtgtacttt

SEQ ID NO: 9328 - DNA, 33 bp, homo sapien
gagttccaatgacatcwacttttattaatttca

SEQ ID NO: 9329 - DNA, 33 bp, homo sapien
cctaggaacttgttaawttgttgtgattaaaat

SEQ ID NO: 9330 - DNA, 33 bp, homo sapien
acgcctgcatcatgggrttaagaaaaaaaacaa

SEQ ID NO: 9331 - DNA, 33 bp, homo sapien
gtagcttttaggtatayggcacaggctttatga

SEQ ID NO: 9332 - DNA, 33 bp, homo sapien
agtaaagcacatttcayggaccgtgcatctcaa

SEQ ID NO: 9333 - DNA, 33 bp, homo sapien
atgagcaacagttcatygtgtttcaaatattcc

SEQ ID NO: 9334 - DNA, 33 bp, homo sapien
cacttataatgcatgawtgtaaggtatgaatcc

SEQ ID NO: 9335 - DNA, 33 bp, homo sapien
gaatgtgccttaatctytgtatctcctgaaatt

SEQ ID NO: 9336 - DNA, 33 bp, homo sapien
cctagtttgcacagttygaggctcaaaaagaga

SEQ ID NO: 9337 - DNA, 33 bp, homo sapien
ggcgtgctggtgctttmaagtgaggcttctcta

SEQ ID NO: 9338 - DNA, 33 bp, homo sapien
ctctgctcttttctttygtgatacttatctcaa

SEQ ID NO: 9339 - DNA, 33 bp, homo sapien
accacacgcacacatcrtgaatgactcaaaagc

SEQ ID NO: 9340 - DNA, 33 bp, homo sapien
agatgctttattcaaaygactggttggggtgct

SEQ ID NO: 9341 - DNA, 33 bp, homo sapien
cctgtgtggacagctcrtcaataacacattact

SEQ ID NO: 9342 - DNA, 33 bp, homo sapien
tctttgtacttcctgtyagtcaggcagaggacc

SEQ ID NO: 9343 - DNA, 33 bp, homo sapien
tgagtatgcaaaaaagsctaaaacaaaagtgcc

SEQ ID NO: 9344 - DNA, 33 bp, homo sapien
ttgcactcacaaaggaygtgtctctcacagtac

SEQ ID NO: 9345 - DNA, 33 bp, homo sapien
ggtcacaatatacagakaaatttttaggctgaa

SEQ ID NO: 9346 - DNA, 33 bp, homo sapien
gagccaggattttgtaygtggatgagattcttc

SEQ ID NO: 9347 - DNA, 33 bp, homo sapien
aagtaggctttatccakgagatgtaaggttggt

SEQ ID NO: 9348 - DNA, 33 bp, homo sapien
tattaatatgatctaaygggacttaatttcctc

SEQ ID NO: 9349 - DNA, 33 bp, homo sapien
gacctagtggtgttctstctctactgcactttg

SEQ ID NO: 9350 - DNA, 33 bp, homo sapien
ctgactctaactccacrtagaaagtatcagaat

SEQ ID NO: 9351 - DNA, 33 bp, homo sapien
tcttgctacagataaasagggaggaaatgacag

SEQ ID NO: 9352 - DNA, 33 bp, homo sapien
cttgtgcaagctcaatragaacagggactgact

SEQ ID NO: 9353 - DNA, 33 bp, homo sapien
cttcttgctcactcaaytgcctaaaaacgaatg

SEQ ID NO: 9354 - DNA, 33 bp, homo sapien
tactggatttcaaagaytgtataaaaaaacaga

SEQ ID NO: 9355 - DNA, 33 bp, homo sapien
ctgttccacaaaagctrggagtaataataaatg

SEQ ID NO: 9356 - DNA, 33 bp, homo sapien
tgggagtcagtgtatcyattttatgtcatttgc

SEQ ID NO: 9357 - DNA, 33 bp, homo sapien
cactgtggatctgtacrtttccttagggcattg

SEQ ID NO: 9358 - DNA, 33 bp, homo sapien
catttcttggtaatgargaccactgcagtgtgt

SEQ ID NO: 9359 - DNA, 33 bp, homo sapien
cacagaaagtttatggsaataataggtagaacg

SEQ ID NO: 9360 - DNA, 33 bp, homo sapien
aaataatgagaaacaaygaagcaagcctacaag

SEQ ID NO: 9361 - DNA, 33 bp, homo sapien
tgaactatccataattytgtttcttttttcttc

SEQ ID NO: 9362 - DNA, 33 bp, homo sapien
cttaatatgcaactctytaatggctaataatgt

SEQ ID NO: 9363 - DNA, 33 bp, homo sapien
aggcatgaggttaaagmaaaactgtggcaaggg

SEQ ID NO: 9364 - DNA, 33 bp, homo sapien
actctaatatattccartgcaatcctagcacaa

SEQ ID NO: 9365 - DNA, 33 bp, homo sapien
gtttatagcaaatatasggctttagaagatctt

SEQ ID NO: 9366 - DNA, 33 bp, homo sapien
tttaggaagtagaaatkcttggagataaaattg

SEQ ID NO: 9367 - DNA, 33 bp, homo sapien
aacaaatcagatcaaarcctgaaatgatcaaat

SEQ ID NO: 9368 - DNA, 33 bp, homo sapien
gaaaagttgaacaaatwacccaagtttacaaga

SEQ ID NO: 9369 - DNA, 33 bp, homo sapien
aactttacgtcttagtsaacacttaatattatg

SEQ ID NO: 9370 - DNA, 33 bp, homo sapien
tagaaaagccacctcayttcctggcatggcagt

SEQ ID NO: 9371 - DNA, 33 bp, homo sapien
agatgtgctgccattcrgactgttgttttattt

SEQ ID NO: 9372 - DNA, 33 bp, homo sapien
tcataatctatttctgscttttattttaatgtc

SEQ ID NO: 9373 - DNA, 33 bp, homo sapien
tttagtcagcaagagamcacatatacgatgatg

SEQ ID NO: 9374 - DNA, 33 bp, homo sapien
tcctgtgacaatctaaygccactggtaagctca

SEQ ID NO: 9375 - DNA, 33 bp, homo sapien
tcttatttacacaccgwtggatttggcttgctg

SEQ ID NO: 9376 - DNA, 33 bp, homo sapien
gcgagctggaaaatacyaacggcaactccaccc

SEQ ID NO: 9377 - DNA, 33 bp, homo sapien
tgcccttccttagaatrgaaggctgttctacaa

SEQ ID NO: 9378 - DNA, 33 bp, homo sapien
ttctatactaaataaaygcttggagtgcggagc

SEQ ID NO: 9379 - DNA, 33 bp, homo sapien
atgttagattttggctstgttctcaacttcttc

SEQ ID NO: 9380 - DNA, 33 bp, homo sapien
gaataatacatttcctkttgtggaagcaggagg

SEQ ID NO: 9381 - DNA, 33 bp, homo sapien
ttactctgtatactttmcttgcctttattttct

SEQ ID NO: 9382 - DNA, 33 bp, homo sapien
ctggcttctccagcacytaaactggtatatatt

SEQ ID NO: 9383 - DNA, 33 bp, homo sapien
aagagtaatgagacctytgtattataacttgaa

SEQ ID NO: 9384 - DNA, 33 bp, homo sapien
aggaagcaaaaagagtrctgttatcacccctcc

SEQ ID NO: 9385 - DNA, 33 bp, homo sapien
ctgagatctctttctaytgtggatgaaggaaga

SEQ ID NO: 9386 - DNA, 33 bp, homo sapien
ggggtccagagatactrtgtgcaaaatatcagc

SEQ ID NO: 9387 - DNA, 33 bp, homo sapien
atctaaagctcagagaygttaagcaatttgttc

SEQ ID NO: 9388 - DNA, 33 bp, homo sapien
aatatgagtgtgcatawtctcttccagatcctg

SEQ ID NO: 9389 - DNA, 33 bp, homo sapien
ttactttccatttgagwtacagctctggattgt

SEQ ID NO: 9390 - DNA, 33 bp, homo sapien
atgtgacttggatactrttaaaagcatttagtt

SEQ ID NO: 9391 - DNA, 33 bp, homo sapien
tattacatgccaatackacatacttttcatata

SEQ ID NO: 9392 - DNA, 33 bp, homo sapien
aactgaagctggtgcaytctgaaaacaagagtc

SEQ ID NO: 9393 - DNA, 33 bp, homo sapien
taaccaagctgaccatsaaggatctgcctgccc

SEQ ID NO: 9394 - DNA, 33 bp, homo sapien
ggtgacgtgatgacccmtatgcaaatgttcagt

SEQ ID NO: 9395 - DNA, 33 bp, homo sapien
acagtcaatcctctctyaaaaaaaatcaatccc

SEQ ID NO: 9396 - DNA, 33 bp, homo sapien
ttctgtaggttgcattyggttaattatattctt

SEQ ID NO: 9397 - DNA, 33 bp, homo sapien
tttctgttgcttacaayagtaaaagtcctgact

SEQ ID NO: 9398 - DNA, 33 bp, homo sapien
atacacaaggttagtgyatgagtaacaattcgg

SEQ ID NO: 9399 - DNA, 33 bp, homo sapien
tctgatgaggttaacaytgatgatcagtagacc

SEQ ID NO: 9400 - DNA, 33 bp, homo sapien
gtaacagtccaaaagckgtctctcaaaaggaga

SEQ ID NO: 9401 - DNA, 33 bp, homo sapien
caagaaaaacaaacaamggacatcgaaacaaac

SEQ ID NO: 9402 - DNA, 33 bp, homo sapien
ttgttactattagaacmggcttacaagagaccc

SEQ ID NO: 9403 - DNA, 33 bp, homo sapien
tcagttaccaattctgytgaacgggataataat

SEQ ID NO: 9404 - DNA, 33 bp, homo sapien
tcttttctttctttcayctgcatgtttacatat

SEQ ID NO: 9405 - DNA, 33 bp, homo sapien
cctatgtaacattgctmaaagtcctatgcagta

SEQ ID NO: 9406 - DNA, 33 bp, homo sapien
gtatgttaattacggaygcaaacaaggcctgaa

SEQ ID NO: 9407 - DNA, 33 bp, homo sapien
tttcaagaatcctcacmtggctgtaaaaaccac

SEQ ID NO: 9408 - DNA, 33 bp, homo sapien
accctgggtgaacccgracttcaaagtgttttg

SEQ ID NO: 9409 - DNA, 33 bp, homo sapien
gcaaatagacttattgygaagaatgtacttcag

SEQ ID NO: 9410 - DNA, 33 bp, homo sapien
cagcaagcagagtatgygataagagatagaaac

SEQ ID NO: 9411 - DNA, 33 bp, homo sapien
atgctactctgtgactytgaagatggataaagg

SEQ ID NO: 9412 - DNA, 33 bp, homo sapien
tatctgaccgtgcatcsactcaccttatctgtc

SEQ ID NO: 9413 - DNA, 33 bp, homo sapien
ctaagcacgtattctcytgcaacaactggctga

SEQ ID NO: 9414 - DNA, 33 bp, homo sapien
agaagcttcaaatgacratagtttaccttctcc

SEQ ID NO: 9415 - DNA, 33 bp, homo sapien
cataaaaactagacgaractttcttttgattga

SEQ ID NO: 9416 - DNA, 33 bp, homo sapien
ctctgactttgaagacycattagtaatatccag

SEQ ID NO: 9417 - DNA, 33 bp, homo sapien
aagttcaattttttaargacatgttcaatttat

SEQ ID NO: 9418 - DNA, 33 bp, homo sapien
ggcctcctagattaagrcctgcctggaatggat

SEQ ID NO: 9419 - DNA, 33 bp, homo sapien
gagacagcgataccackctcttccacgtaggaa

SEQ ID NO: 9420 - DNA, 33 bp, homo sapien
ggagtttctcatttacrgtccttttgcatctcc

SEQ ID NO: 9421 - DNA, 33 bp, homo sapien
gatagatagatagatayaaccatggagtcctat

SEQ ID NO: 9422 - DNA, 33 bp, homo sapien
cttctctcattaaacayttatttctggcaatta

SEQ ID NO: 9423 - DNA, 33 bp, homo sapien
gatatctttctgtctaygctcccatcttttgcc

SEQ ID NO: 9424 - DNA, 33 bp, homo sapien
ttagattttgcataccrattacaactctgcctc

SEQ ID NO: 9425 - DNA, 33 bp, homo sapien
tttttcaaatacaaatygacaatccagagccta

SEQ ID NO: 9426 - DNA, 33 bp, homo sapien
gcttagagcagatcaarcaacaccactttgggg

SEQ ID NO: 9427 - DNA, 33 bp, homo sapien
aaattcatttgtttctkagaccaggaaataact

SEQ ID NO: 9428 - DNA, 33 bp, homo sapien
tttatggacaaccttgrtaagaccccactactc

SEQ ID NO: 9429 - DNA, 33 bp, homo sapien
tgactttccaaaattcrtctcaaattaaggtgt

SEQ ID NO: 9430 - DNA, 33 bp, homo sapien
taatgagcccgtcaaargcattcttatttctgt

SEQ ID NO: 9431 - DNA, 33 bp, homo sapien
atcatgagagagcaaaygttcaatattctatac

SEQ ID NO: 9432 - DNA, 33 bp, homo sapien
aaagacactgtgctcartatttactgttgatgc

SEQ ID NO: 9433 - DNA, 33 bp, homo sapien
tccacatataaatggaygcatgcagttgaaacc

SEQ ID NO: 9434 - DNA, 33 bp, homo sapien
gaattcctgagtttgarccatcttccagcctca

SEQ ID NO: 9435 - DNA, 33 bp, homo sapien
atttcacttcaccaacmcgtttgccctgtatga

SEQ ID NO: 9436 - DNA, 33 bp, homo sapien
ttaccttgcattgtagyagttttgcaagcccca

SEQ ID NO: 9437 - DNA, 33 bp, homo sapien
attagcttctttctttyccaaaatcaccatagc

SEQ ID NO: 9438 - DNA, 33 bp, homo sapien
gacccttttcctgcctscttatttgactgttaa

SEQ ID NO: 9439 - DNA, 33 bp, homo sapien
gcgaagaggcaaattgyagaatctaatccttct

SEQ ID NO: 9440 - DNA, 33 bp, homo sapien
ctaaatggttgttttayaccactgagttccggg

SEQ ID NO: 9441 - DNA, 33 bp, homo sapien
cttacttcatcttcgtktttcagcttactaacc

SEQ ID NO: 9442 - DNA, 33 bp, homo sapien
taattgaattgtgcatygtatggttggcacaat

SEQ ID NO: 9443 - DNA, 33 bp, homo sapien
agattactcaggaaggygccagagacacgatga

SEQ ID NO: 9444 - DNA, 33 bp, homo sapien
attatgcaattgttccrtcagagaatttgtttt

SEQ ID NO: 9445 - DNA, 33 bp, homo sapien
gatggttctttctctgkgctcaagaagtttcac

SEQ ID NO: 9446 - DNA, 33 bp, homo sapien
ctctctggttcagttgrtataatacaattctct

SEQ ID NO: 9447 - DNA, 33 bp, homo sapien
taggaaaaaaagcaackgtaatgagccaaaaaa

SEQ ID NO: 9448 - DNA, 33 bp, homo sapien
tactctggtgccctagyttgtcagccaaaccat

SEQ ID NO: 9449 - DNA, 33 bp, homo sapien
tggacctcaaattctcrgccaaagaccctacac

SEQ ID NO: 9450 - DNA, 33 bp, homo sapien
cctgtaggaatcttctygctgaggttagttaaa

SEQ ID NO: 9451 - DNA, 33 bp, homo sapien
tccttcctaaatcctgwatctctatgctgggag

SEQ ID NO: 9452 - DNA, 33 bp, homo sapien
cagtgtagttggcttaytcaaagcagagagtgc

SEQ ID NO: 9453 - DNA, 33 bp, homo sapien
actttgttaaatgtccrgtaccaggtttgcttt

SEQ ID NO: 9454 - DNA, 33 bp, homo sapien
tgttcttttacagtctkcagagaaaaatgctga

SEQ ID NO: 9455 - DNA, 33 bp, homo sapien
attcttcatactggatyataaaggccaacttcc

SEQ ID NO: 9456 - DNA, 33 bp, homo sapien
ctagaactcaatacggyggcaggttctgcatgt

SEQ ID NO: 9457 - DNA, 33 bp, homo sapien
aacacaaatgtaaataktgaaacaccattatct

SEQ ID NO: 9458 - DNA, 33 bp, homo sapien
acctgtacttcctgaaygtagccctgctgtggt

SEQ ID NO: 9459 - DNA, 33 bp, homo sapien
aaagattttttttctcyaagcctcatcctcctc

SEQ ID NO: 9460 - DNA, 33 bp, homo sapien
aaatctttagaagcctyattggagatttcttgc

SEQ ID NO: 9461 - DNA, 33 bp, homo sapien
aatctccaaaaactttsccaatgtatttattga

SEQ ID NO: 9462 - DNA, 33 bp, homo sapien
gagttagggagaaaggycatatacacacttaaa

SEQ ID NO: 9463 - DNA, 33 bp, homo sapien
cagcccttacggttcarcaagcttcccctaaca

SEQ ID NO: 9464 - DNA, 33 bp, homo sapien
ttccaaataaaatggaraaacctggacaaataa

SEQ ID NO: 9465 - DNA, 33 bp, homo sapien
cctgcgagctccctacraactccccggtgcttg

SEQ ID NO: 9466 - DNA, 33 bp, homo sapien
ggtgttttattgacatmtactccttctctataa

SEQ ID NO: 9467 - DNA, 33 bp, homo sapien
caaattatgctcaactygagtgcctttactggc

SEQ ID NO: 9468 - DNA, 33 bp, homo sapien
tcccttactttctccaraatatacagtctctgt

SEQ ID NO: 9469 - DNA, 33 bp, homo sapien
agctagttggtagtagmctggaattccttttag

SEQ ID NO: 9470 - DNA, 33 bp, homo sapien
tgtgcaaagatcaggayggaagcaaggctgtcc

SEQ ID NO: 9471 - DNA, 33 bp, homo sapien
gattctttctgctaccwtgaagtccaagaagaa

SEQ ID NO: 9472 - DNA, 33 bp, homo sapien
tgtgataaccaaatacrtctccagacactgtca

SEQ ID NO: 9473 - DNA, 33 bp, homo sapien
aacagctcaatcaagakaacagtcaaaatctgt

SEQ ID NO: 9474 - DNA, 33 bp, homo sapien
gacccacaaatccacayaaaaggtcaaggaaat

SEQ ID NO: 9475 - DNA, 33 bp, homo sapien
tctattttatatccaarcaagtcaagctagaac

SEQ ID NO: 9476 - DNA, 33 bp, homo sapien
cgcccagaattgaactratggtggcttgtattt

SEQ ID NO: 9477 - DNA, 33 bp, homo sapien
tctaaaattagatagtsgttatggcctcacaac

SEQ ID NO: 9478 - DNA, 33 bp, homo sapien
ttctaatcttggtattkttcatcaattttaatt

SEQ ID NO: 9479 - DNA, 33 bp, homo sapien
ggactgtgatgacaccrcttgatcaaaccatct

SEQ ID NO: 9480 - DNA, 33 bp, homo sapien
tctttttgtgcaacatyggtgcagtttggcaag

SEQ ID NO: 9481 - DNA, 33 bp, homo sapien
gttttgcttgatattcrtgaacatttcactctt

SEQ ID NO: 9482 - DNA, 33 bp, homo sapien
atacacaacgcactagmagtgtttaagagagta

SEQ ID NO: 9483 - DNA, 33 bp, homo sapien
atctcaagaccacaacrggaacatagccaagtc

SEQ ID NO: 9484 - DNA, 33 bp, homo sapien
acacatagggattcctstaacagatctgggcaa

SEQ ID NO: 9485 - DNA, 33 bp, homo sapien
tctcataatgtgcttcytgaactccctgcagca

SEQ ID NO: 9486 - DNA, 33 bp, homo sapien
tggagttgatttcaacyggactaagccaatttc

SEQ ID NO: 9487 - DNA, 33 bp, homo sapien
tacaaatcaaagtggartccacaagccagcagc

SEQ ID NO: 9488 - DNA, 33 bp, homo sapien
acctcagggatcctttygatgcactgaccagga

SEQ ID NO: 9489 - DNA, 33 bp, homo sapien
ttaatacagaggatcasattctagttttgcata

SEQ ID NO: 9490 - DNA, 33 bp, homo sapien
tagctttgggtcctctrtagcacttactagagt

SEQ ID NO: 9491 - DNA, 33 bp, homo sapien
tgttgttgttcctgtcrtgaatggagtcttatt

SEQ ID NO: 9492 - DNA, 33 bp, homo sapien
catttgtaagtccacaygctcaggtttgcctaa

SEQ ID NO: 9493 - DNA, 33 bp, homo sapien
attgaggtatagagatkttaaccacttggttga

SEQ ID NO: 9494 - DNA, 33 bp, homo sapien
tattagtcatgatatakggaattgaaaagacat

SEQ ID NO: 9495 - DNA, 33 bp, homo sapien
aatgcacgggttgaccytacagaaaagaaaatt

SEQ ID NO: 9496 - DNA, 33 bp, homo sapien
attatgctgagtatgtygactgatccaattgat

SEQ ID NO: 9497 - DNA, 33 bp, homo sapien
aagcaaacttgttcatygcctatcaagcactac

SEQ ID NO: 9498 - DNA, 33 bp, homo sapien
aagtattgttattatcsttccaaaaatagacac

SEQ ID NO: 9499 - DNA, 33 bp, homo sapien
gcatgttttctacattrtcctccttagtgcagc

SEQ ID NO: 9500 - DNA, 33 bp, homo sapien
ttgagataggtcagaastagatgtagagattca

SEQ ID NO: 9501 - DNA, 33 bp, homo sapien
tcactctggaccggctyactggactcattcagc

SEQ ID NO: 9502 - DNA, 33 bp, homo sapien
ctgggggctatttcttygtgtactagtagtgga

SEQ ID NO: 9503 - DNA, 33 bp, homo sapien
acacccagctgtattgygtccatttaacattat

SEQ ID NO: 9504 - DNA, 33 bp, homo sapien
aaccaatacatacagaytttttgtgtggtcaga

SEQ ID NO: 9505 - DNA, 33 bp, homo sapien
tttcagctaaatagagrcgttgcaggagacccc

SEQ ID NO: 9506 - DNA, 33 bp, homo sapien
atgtgcgtatgccttarcttttcagaaatgggg

SEQ ID NO: 9507 - DNA, 33 bp, homo sapien
gtaattcttactttgtyttagcccacaggatga

SEQ ID NO: 9508 - DNA, 33 bp, homo sapien
gctgggctttggagtasaaacgatcccatcatc

SEQ ID NO: 9509 - DNA, 33 bp, homo sapien
ccttaaaacacagatgstgagccccaccccaga

SEQ ID NO: 9510 - DNA, 33 bp, homo sapien
cacagacttgtactttragtttgattgaccagt

SEQ ID NO: 9511 - DNA, 33 bp, homo sapien
taaaagtgtttgaaggktcagtcacgtctcacc

SEQ ID NO: 9512 - DNA, 33 bp, homo sapien
atctttaatgaaaatcrgtagaccatgttggag

SEQ ID NO: 9513 - DNA, 33 bp, homo sapien
agaatggagcatgaagytgcacaggcatcaggg

SEQ ID NO: 9514 - DNA, 33 bp, homo sapien
gacctcccctggcacasggtttgagatggtctt

SEQ ID NO: 9515 - DNA, 33 bp, homo sapien
tccttccattagatgaygtgtgatcagagagtg

SEQ ID NO: 9516 - DNA, 33 bp, homo sapien
tatttagttgtagttakaggcatcccagaaaaa

SEQ ID NO: 9517 - DNA, 33 bp, homo sapien
gactggaatcagggacktttcctggaggagctg

SEQ ID NO: 9518 - DNA, 33 bp, homo sapien
tgcacatgtatacttaytgacctgctgccattc

SEQ ID NO: 9519 - DNA, 33 bp, homo sapien
ctgccatttatacatcrtcactctctggaatgc

SEQ ID NO: 9520 - DNA, 33 bp, homo sapien
atgtgcgttttcatccyacaaattcgaatcttt

SEQ ID NO: 9521 - DNA, 33 bp, homo sapien
cctgccactttctatgygtatatggtcaacatg

SEQ ID NO: 9522 - DNA, 33 bp, homo sapien
ttataagagcaagataycttttagtctatttct

SEQ ID NO: 9523 - DNA, 33 bp, homo sapien
ctctgcatcttttagaytggtggttgtcaataa

SEQ ID NO: 9524 - DNA, 33 bp, homo sapien
caagctctaaacacagrttatatcctatttgga

SEQ ID NO: 9525 - DNA, 33 bp, homo sapien
tgtcccaggcttgtgawatcctagtggccactc

SEQ ID NO: 9526 - DNA, 33 bp, homo sapien
cactttaaatatgtgcrccttattgtatgtcag

SEQ ID NO: 9527 - DNA, 33 bp, homo sapien
ataacatcagatactgkgaaggcacaatgggac

SEQ ID NO: 9528 - DNA, 33 bp, homo sapien
aggtacacccatcagayggagagttggtctttt

SEQ ID NO: 9529 - DNA, 33 bp, homo sapien
ttgaaaaagatctgcarcgtctcaacagggtaa

SEQ ID NO: 9530 - DNA, 33 bp, homo sapien
gaaggaaactcatataratgtaggaggaattaa

SEQ ID NO: 9531 - DNA, 33 bp, homo sapien
gttcttccctttccacyttcactgacttgcttt

SEQ ID NO: 9532 - DNA, 33 bp, homo sapien
cagagcctctcgatgasctatgaacaggaacag

SEQ ID NO: 9533 - DNA, 33 bp, homo sapien
catacctagattttttkgtttacaaagtttatt

SEQ ID NO: 9534 - DNA, 33 bp, homo sapien
taaatgtgttatctgarcaagcaaaacctaaga

SEQ ID NO: 9535 - DNA, 33 bp, homo sapien
gaagccaggcaaagacrttgattccaaggcagg

SEQ ID NO: 9536 - DNA, 33 bp, homo sapien
aggttgttgcaaaaatwcatgagattatatgta

SEQ ID NO: 9537 - DNA, 33 bp, homo sapien
tcgcattagattctcakaggtgcgtcaacccta

SEQ ID NO: 9538 - DNA, 33 bp, homo sapien
tgacctacacatacacmcaagagacatgccttc

SEQ ID NO: 9539 - DNA, 33 bp, homo sapien
actgtaggttgattgayagaaataagagttaag

SEQ ID NO: 9540 - DNA, 33 bp, homo sapien
ccaggagtttgagaccwgattgagcaacatagt

SEQ ID NO: 9541 - DNA, 33 bp, homo sapien
gcagcagcatttcccayatgagcactgcaaact

SEQ ID NO: 9542 - DNA, 33 bp, homo sapien
aatcctatccaactggsagcactgtaggtttgt

SEQ ID NO: 9543 - DNA, 33 bp, homo sapien
gcctactaaacaacaayttctgagttaacaata

SEQ ID NO: 9544 - DNA, 33 bp, homo sapien
gtgctaccatgcctgartaattttttgtagaga

SEQ ID NO: 9545 - DNA, 33 bp, homo sapien
aggggtcaagtgtgagmctcaaagttagacaac

SEQ ID NO: 9546 - DNA, 33 bp, homo sapien
tggcaataggggtgccrgtgaacaagtccccac

SEQ ID NO: 9547 - DNA, 33 bp, homo sapien
attctcatagagtttgsagactagtgagaaagc

SEQ ID NO: 9548 - DNA, 33 bp, homo sapien
actcctgtgtccttttkacatacttttattatc

SEQ ID NO: 9549 - DNA, 33 bp, homo sapien
cactttattagaatatrgccaaacatgacaagt

SEQ ID NO: 9550 - DNA, 33 bp, homo sapien
aaagaggaaaaaagaaygtgaagactcaggact

SEQ ID NO: 9551 - DNA, 33 bp, homo sapien
tatgcctgttcttgtaygaaccaaatgaagact

SEQ ID NO: 9552 - DNA, 33 bp, homo sapien
ggcactttgatttcagmtttctaacctttggaa

SEQ ID NO: 9553 - DNA, 33 bp, homo sapien
tgagtgccttgctagtstcaccctgggctcaac

SEQ ID NO: 9554 - DNA, 33 bp, homo sapien
gtagcatacaatcagargaggctggaaaacggg

SEQ ID NO: 9555 - DNA, 33 bp, homo sapien
agaagatagtgttagaractgggaatctgtctt

SEQ ID NO: 9556 - DNA, 33 bp, homo sapien
ccattcatttacatgtygtctgggctgctttca

SEQ ID NO: 9557 - DNA, 33 bp, homo sapien
agcagttctctctgggwaggattgtggtataat

SEQ ID NO: 9558 - DNA, 33 bp, homo sapien
aaaggtttcctaattayttcaccaaaatcaggt

SEQ ID NO: 9559 - DNA, 33 bp, homo sapien
tgcttgttgcttagacmatgcctagtccagata

SEQ ID NO: 9560 - DNA, 33 bp, homo sapien
caccaaaaacgaaacarcccagtgtccgtgagc

SEQ ID NO: 9561 - DNA, 33 bp, homo sapien
tttcctggcagcatgcygtgagagtcactctga

SEQ ID NO: 9562 - DNA, 33 bp, homo sapien
ctatccagagtatgctwctttccgaggcaatgg

SEQ ID NO: 9563 - DNA, 33 bp, homo sapien
gcatcagaatagtcctkcaaagccagagtattg

SEQ ID NO: 9564 - DNA, 33 bp, homo sapien
tgcagacagagggcttstcaagtataaaacctt

SEQ ID NO: 9565 - DNA, 33 bp, homo sapien
ggggcctaagtcacttmtctgagtcagcccttc

SEQ ID NO: 9566 - DNA, 33 bp, homo sapien
aagtggagattaaaatmgtacctacctcataaa

SEQ ID NO: 9567 - DNA, 33 bp, homo sapien
tcaggtctctttttccrtgaaatgcctgttcat

SEQ ID NO: 9568 - DNA, 33 bp, homo sapien
aaacgatactgggcagygaaacaacacatccat

SEQ ID NO: 9569 - DNA, 33 bp, homo sapien
aagcgattggaaaatgraagcaagatgtcctta

SEQ ID NO: 9570 - DNA, 33 bp, homo sapien
acatgcatatgctttgyagtaacatgggatttt

SEQ ID NO: 9571 - DNA, 33 bp, homo sapien
ccacttggtacctgccwcctcggcatccaatat

SEQ ID NO: 9572 - DNA, 33 bp, homo sapien
tcatgattctgctgatrtaaagtcaaactcata

SEQ ID NO: 9573 - DNA, 33 bp, homo sapien
aaaagcgaagtgaaaakaatgcattaaggtttt

SEQ ID NO: 9574 - DNA, 33 bp, homo sapien
caaacacgaaagcaatraagtcaagacagtggg

SEQ ID NO: 9575 - DNA, 33 bp, homo sapien
tatgtggaaaatgtcamatccaaaggaatgtaa

SEQ ID NO: 9576 - DNA, 33 bp, homo sapien
ggagaaataagctaagmaacaatgggataattt

SEQ ID NO: 9577 - DNA, 33 bp, homo sapien
tacttgctgcctattgraagcaaagatagcaac

SEQ ID NO: 9578 - DNA, 33 bp, homo sapien
acaagaataaaagaccyacaatccaattaaaaa

SEQ ID NO: 9579 - DNA, 33 bp, homo sapien
acagcattaaagttcakaaagtttgcagcctga

SEQ ID NO: 9580 - DNA, 33 bp, homo sapien
ttgttgcttcgagtttkactttgaaatgtgctc

SEQ ID NO: 9581 - DNA, 33 bp, homo sapien
atttctaagatattcarctctcaacattagaat

SEQ ID NO: 9582 - DNA, 33 bp, homo sapien
tctcacctgtgtgctcyctgactggcaatcctt

SEQ ID NO: 9583 - DNA, 33 bp, homo sapien
tgatttctctctttggrtatcaaggtctggtag

SEQ ID NO: 9584 - DNA, 33 bp, homo sapien
cggtttcactgccttcrttgctatccgactcag

SEQ ID NO: 9585 - DNA, 33 bp, homo sapien
gtggcccaggcgctgartgggctttggaggtga

SEQ ID NO: 9586 - DNA, 33 bp, homo sapien
caggaagtgccttacaygttcacgcagtccaca

SEQ ID NO: 9587 - DNA, 33 bp, homo sapien
caatgcccagatgctgraagaacatttactagc

SEQ ID NO: 9588 - DNA, 33 bp, homo sapien
gatcaaaatttgccagyctttttcacttctgcc

SEQ ID NO: 9589 - DNA, 33 bp, homo sapien
caaatgcaaaagtcccrcatgtcctcattattg

SEQ ID NO: 9590 - DNA, 33 bp, homo sapien
cattcctacctttcaawataggagccaaagatg

SEQ ID NO: 9591 - DNA, 33 bp, homo sapien
tcaacctgggtcatggkcagagatggtgcttat

SEQ ID NO: 9592 - DNA, 33 bp, homo sapien
ggccagtccatttggtyaactcctcatttattc

SEQ ID NO: 9593 - DNA, 33 bp, homo sapien
caaactaactttacaaytgaagggagggatgag

SEQ ID NO: 9594 - DNA, 33 bp, homo sapien
aagaggagcatctaacmcatgcttgaaagaatc

SEQ ID NO: 9595 - DNA, 33 bp, homo sapien
gatcacctagaatccayagtttacaacgccttt

SEQ ID NO: 9596 - DNA, 33 bp, homo sapien
aattttgcactcggacygcttcacaggtgtcca

SEQ ID NO: 9597 - DNA, 33 bp, homo sapien
tagaattagcacacaaraacattaagaaagcta

SEQ ID NO: 9598 - DNA, 33 bp, homo sapien
tggcttagctgcttggraagtcagtcacatttg

SEQ ID NO: 9599 - DNA, 33 bp, homo sapien
ttttgaataggctatcmgttgcccaatagccat

SEQ ID NO: 9600 - DNA, 33 bp, homo sapien
ggatttgcagtattagracacagacatccttag

SEQ ID NO: 9601 - DNA, 33 bp, homo sapien
ttaaaacatttcctgcraagatatttttcactt

SEQ ID NO: 9602 - DNA, 33 bp, homo sapien
cacagggttcacaagcrtcagaggcaggattcc

SEQ ID NO: 9603 - DNA, 33 bp, homo sapien
gatatggtttccagggytgtaatattatacttt

SEQ ID NO: 9604 - DNA, 33 bp, homo sapien
attctttaaaactttcrttaaacatggtgaatt

SEQ ID NO: 9605 - DNA, 33 bp, homo sapien
cgaaaccctgcttctgrgttagacacacttggt

SEQ ID NO: 9606 - DNA, 33 bp, homo sapien
gaatcttacatcgcagmaaatgttaatgagtaa

SEQ ID NO: 9607 - DNA, 33 bp, homo sapien
gtaatatatgtgttcgrctttatatctgccttt

SEQ ID NO: 9608 - DNA, 33 bp, homo sapien
ggctgagagcacccaartgttatattgttctat

SEQ ID NO: 9609 - DNA, 33 bp, homo sapien
tgagtcatctggtaacygtgtgtttaataatag

SEQ ID NO: 9610 - DNA, 33 bp, homo sapien
ggagatgtatgaagaarttaatgttgttttcat

SEQ ID NO: 9611 - DNA, 33 bp, homo sapien
cctagagaggatgaagktagccttgttgagcta

SEQ ID NO: 9612 - DNA, 33 bp, homo sapien
ggtaggtatcttaagtragtgaagcaggcaggg

SEQ ID NO: 9613 - DNA, 33 bp, homo sapien
taggctttttgaaatgstaaataaacactgaat

SEQ ID NO: 9614 - DNA, 33 bp, homo sapien
gggggaagtagttgttytcagatgtggggatct

SEQ ID NO: 9615 - DNA, 33 bp, homo sapien
cccagtgttttctacamctcccgagtccactct

SEQ ID NO: 9616 - DNA, 33 bp, homo sapien
gactggcaaaattaaasgtatattaaatagcaa

SEQ ID NO: 9617 - DNA, 33 bp, homo sapien
tcaccagaggatccagmtttccctgtggcctcg

SEQ ID NO: 9618 - DNA, 33 bp, homo sapien
tgctcaattctttcttraactacaaaagcaatc

SEQ ID NO: 9619 - DNA, 33 bp, homo sapien
ggccaaagctagaacamtgagcaacaaaataaa

SEQ ID NO: 9620 - DNA, 33 bp, homo sapien
atgaatgctcacagaakatctgagaagacccta

SEQ ID NO: 9621 - DNA, 33 bp, homo sapien
aaatgaactttccttcytggaatttgtccaatt

SEQ ID NO: 9622 - DNA, 33 bp, homo sapien
ttgtgatccaagctgtmgtccacagatctacct

SEQ ID NO: 9623 - DNA, 33 bp, homo sapien
agtagaaacagatataktcaaatgtttgtctcc

SEQ ID NO: 9624 - DNA, 33 bp, homo sapien
ttaagctactgtatttwaaattggcttattcca

SEQ ID NO: 9625 - DNA, 33 bp, homo sapien
gtgtttatgtgctgtakgtatatctgtacttta

SEQ ID NO: 9626 - DNA, 33 bp, homo sapien
tgtgtctgggtattttkttcttttagcataggc

SEQ ID NO: 9627 - DNA, 33 bp, homo sapien
acagcaaaaatacccarcagtgacaacatccag

SEQ ID NO: 9628 - DNA, 33 bp, homo sapien
gagtcaatcaaaccttyttcctttataaattac

SEQ ID NO: 9629 - DNA, 33 bp, homo sapien
gacaagcgttttgattwagtgctggatttggtt

SEQ ID NO: 9630 - DNA, 33 bp, homo sapien
ccatttcttaggtgttsaggcaaggttgggata

SEQ ID NO: 9631 - DNA, 33 bp, homo sapien
ctggatgccaatcatcrgtagcacgcaccccca

SEQ ID NO: 9632 - DNA, 33 bp, homo sapien
tctgcttctgcttaagwacattcctcttggttt

SEQ ID NO: 9633 - DNA, 33 bp, homo sapien
agcccaatagagttgayaggataattagctaag

SEQ ID NO: 9634 - DNA, 33 bp, homo sapien
gctttcttagaaaaggmtttgtgatctgtgcat

SEQ ID NO: 9635 - DNA, 33 bp, homo sapien
cctgacacatactctcrtcttctgacaaaacca

SEQ ID NO: 9636 - DNA, 33 bp, homo sapien
attcaggggtagacacratagcctcaggccttt

SEQ ID NO: 9637 - DNA, 33 bp, homo sapien
ttgtttaattcacagtygaaataggatccttaa

SEQ ID NO: 9638 - DNA, 33 bp, homo sapien
aatgagaaaggaaactrgcaggagatgatgaaa

SEQ ID NO: 9639 - DNA, 33 bp, homo sapien
gtgtgatactgagatarggataaacatataaat

SEQ ID NO: 9640 - DNA, 33 bp, homo sapien
agagagatcagcattcytacttcaccaaaaccc

SEQ ID NO: 9641 - DNA, 33 bp, homo sapien
ataggaataagttttgytggttttcctagtcag

SEQ ID NO: 9642 - DNA, 33 bp, homo sapien
catgaagtccaaagtgktggccattacctacaa

SEQ ID NO: 9643 - DNA, 33 bp, homo sapien
tgttgaagaagaagaasaagtcggaggactgat

SEQ ID NO: 9644 - DNA, 33 bp, homo sapien
tgatgcagtcaggtgamacttaaaagatgagta

SEQ ID NO: 9645 - DNA, 33 bp, homo sapien
cctagtacttgtcactyaagtaatgcctatccc

SEQ ID NO: 9646 - DNA, 33 bp, homo sapien
ttctctctgcacatttyactttttagaatcgta

SEQ ID NO: 9647 - DNA, 33 bp, homo sapien
ttatagcattgtctgaygtgattctaaatgtat

SEQ ID NO: 9648 - DNA, 33 bp, homo sapien
cttattctaagatagtwacttggtcagctagat

SEQ ID NO: 9649 - DNA, 33 bp, homo sapien
gaacaaggatcctcaayattgtactgtaaagtc

SEQ ID NO: 9650 - DNA, 33 bp, homo sapien
atagcccacagaaaatkgacatttgttagtttt

SEQ ID NO: 9651 - DNA, 33 bp, homo sapien
taaatctgcccagttgytcagccagaagaaccc

SEQ ID NO: 9652 - DNA, 33 bp, homo sapien
taggctcttctgtcatratttggaccttaaggg

SEQ ID NO: 9653 - DNA, 33 bp, homo sapien
gatcttaggaaaagccrttcacatcaaggttgc

SEQ ID NO: 9654 - DNA, 33 bp, homo sapien
caacaaagttttatctyggtgaactacctgagt

SEQ ID NO: 9655 - DNA, 33 bp, homo sapien
cttaaaaaagttgagtmcaaaaggatttatctt

SEQ ID NO: 9656 - DNA, 33 bp, homo sapien
ttaataaaaatgtcaasaatattatctctggga

SEQ ID NO: 9657 - DNA, 33 bp, homo sapien
taccagaatgaacttaygccaataacttgcacc

SEQ ID NO: 9658 - DNA, 33 bp, homo sapien
gattcactaggtctgcrgtagaggctgtgcatt

SEQ ID NO: 9659 - DNA, 33 bp, homo sapien
tctccatagctgtttcrctgtcagacaagtaaa

SEQ ID NO: 9660 - DNA, 33 bp, homo sapien
aattataagagaaactmtaaaagcagtgtggca

SEQ ID NO: 9661 - DNA, 33 bp, homo sapien
ggtgctgttgtttgtcytctcagtacagaatgt

SEQ ID NO: 9662 - DNA, 33 bp, homo sapien
aaatgtattaaaacacytcacgcctcaggttgc

SEQ ID NO: 9663 - DNA, 33 bp, homo sapien
ttcctcacaaaatggcwcatcccgccccagcac

SEQ ID NO: 9664 - DNA, 33 bp, homo sapien
taagtggattgactgtkgtcagagcctgtgaca

SEQ ID NO: 9665 - DNA, 33 bp, homo sapien
tgtagagtccaccgtcytgatcccagatgtgag

SEQ ID NO: 9666 - DNA, 33 bp, homo sapien
atgtctgcatttcaagyagcaaaatggaaggag

SEQ ID NO: 9667 - DNA, 33 bp, homo sapien
taaacaaaaatctgagycttgcatatttaaaga

SEQ ID NO: 9668 - DNA, 33 bp, homo sapien
acgtggcaaaagctcamctctactaaaaataca

SEQ ID NO: 9669 - DNA, 33 bp, homo sapien
taagagccgacactgcrgactgtaatgtttccc

SEQ ID NO: 9670 - DNA, 33 bp, homo sapien
agctcttgtcattcagkttaaagagaaaccatt

SEQ ID NO: 9671 - DNA, 33 bp, homo sapien
taatcacaaataacaamaactgaatgtgtctgt

SEQ ID NO: 9672 - DNA, 33 bp, homo sapien
cctctttgtgggattakgttctcctgatcatct

SEQ ID NO: 9673 - DNA, 33 bp, homo sapien
cccatagtatggagtcrcaattacctattagtg

SEQ ID NO: 9674 - DNA, 33 bp, homo sapien
ctggtgttggttccacragaggctcagggacac

SEQ ID NO: 9675 - DNA, 33 bp, homo sapien
aaccataaactccactmtccttcagaccttctc

SEQ ID NO: 9676 - DNA, 33 bp, homo sapien
agtaagttcaaatcccrgtggcatctactaacc

SEQ ID NO: 9677 - DNA, 33 bp, homo sapien
agatcacataattactraaaactgtggcactgc

SEQ ID NO: 9678 - DNA, 33 bp, homo sapien
gatcatttctgcataayttgtgtgtgtgtctat

SEQ ID NO: 9679 - DNA, 33 bp, homo sapien
ggaagtttcatgtgaawtcttttggagattctg

SEQ ID NO: 9680 - DNA, 33 bp, homo sapien
aaatgcctagaagctcytccaaatgaagctcat

SEQ ID NO: 9681 - DNA, 33 bp, homo sapien
caatctacctttttttyccttaaacattggaat

SEQ ID NO: 9682 - DNA, 33 bp, homo sapien
ggaatgtgtggtacaaygtgaagtcagtctggc

SEQ ID NO: 9683 - DNA, 33 bp, homo sapien
acacaagccgctttgcygtgctgattgcttcac

SEQ ID NO: 9684 - DNA, 33 bp, homo sapien
cagaaaaacatgaaaasgagagacaggcctagc

SEQ ID NO: 9685 - DNA, 33 bp, homo sapien
acaaaaagtctgcttgraaacccatcaaaggct

SEQ ID NO: 9686 - DNA, 33 bp, homo sapien
tgtgctgatacctgacraaagagattctaaagc

SEQ ID NO: 9687 - DNA, 33 bp, homo sapien
gctctgcccatcgcgtmtatcaactcatccaca

SEQ ID NO: 9688 - DNA, 33 bp, homo sapien
atgttccatggttttaygcaaatgtctgtatta

SEQ ID NO: 9689 - DNA, 33 bp, homo sapien
aattctgatgtcaaccmggagaatgagttggaa

SEQ ID NO: 9690 - DNA, 33 bp, homo sapien
ggaaagtccatcttttygaggccattcatgtta

SEQ ID NO: 9691 - DNA, 33 bp, homo sapien
aaaatgatttgagagasaatcttggaaaacttg

SEQ ID NO: 9692 - DNA, 33 bp, homo sapien
aagcatttgaatagaakgaatcaatttctgggg

SEQ ID NO: 9693 - DNA, 33 bp, homo sapien
actttatctgatactartatagccattcctgct

SEQ ID NO: 9694 - DNA, 33 bp, homo sapien
caaacatgatgttcttrttccaatccatcatga

SEQ ID NO: 9695 - DNA, 33 bp, homo sapien
tggtgacagcttgcttrctgactcatagatagt

SEQ ID NO: 9696 - DNA, 33 bp, homo sapien
aacaatattctcaacayggcaatgatttttaat

SEQ ID NO: 9697 - DNA, 33 bp, homo sapien
ctagagggagatataasctgtctgcaaagcaaa

SEQ ID NO: 9698 - DNA, 33 bp, homo sapien
ctctgaagtgttaatcrtttacacaagcatgga

SEQ ID NO: 9699 - DNA, 33 bp, homo sapien
ttctgttcttcttgttsattcacatattctgca

SEQ ID NO: 9700 - DNA, 33 bp, homo sapien
ctttctatttctcttgyctttcggagagtttga

SEQ ID NO: 9701 - DNA, 33 bp, homo sapien
tttttatagatttggartcctgttatgttgccc

SEQ ID NO: 9702 - DNA, 33 bp, homo sapien
tactctcttctcacctrcaagaatttataacct

SEQ ID NO: 9703 - DNA, 33 bp, homo sapien
tgagaagagaggcaggragacttaccttgaatc

SEQ ID NO: 9704 - DNA, 33 bp, homo sapien
agggaccacattagacraataacgcattcctgc

SEQ ID NO: 9705 - DNA, 33 bp, homo sapien
cttgtctgttctaccarggactcggtttccatt

SEQ ID NO: 9706 - DNA, 33 bp, homo sapien
ggatgagtgagggaacmatgaaccctacgacct

SEQ ID NO: 9707 - DNA, 33 bp, homo sapien
tagctttgggaaacaamcaacttgccatgtgat

SEQ ID NO: 9708 - DNA, 33 bp, homo sapien
aactgactgagataatraatctatgcccaattt

SEQ ID NO: 9709 - DNA, 33 bp, homo sapien
tggtgattatgtcatgmaatctttgtttgcacc

SEQ ID NO: 9710 - DNA, 33 bp, homo sapien
ttggttgaggtccttarttcagagactccccaa

SEQ ID NO: 9711 - DNA, 33 bp, homo sapien
ccagagagtgaagatasattacctacacaggaa

SEQ ID NO: 9712 - DNA, 33 bp, homo sapien
tccaggagatagagttytcctttgatttgaact

SEQ ID NO: 9713 - DNA, 33 bp, homo sapien
gcactggcattagtgamattgcttcctgatttt

SEQ ID NO: 9714 - DNA, 33 bp, homo sapien
ttcaaatggcatgcccwcttagtaatgaaaaca

SEQ ID NO: 9715 - DNA, 33 bp, homo sapien
aaatagatcaaagagcragctaaacagtccact

SEQ ID NO: 9716 - DNA, 33 bp, homo sapien
tgagagcctgagcttcstaacctatactggatc

SEQ ID NO: 9717 - DNA, 33 bp, homo sapien
tgttgcttctacttgckgtcacttatactgtgc

SEQ ID NO: 9718 - DNA, 33 bp, homo sapien
taaaacaaataaacaamtacaagacataggaaa

SEQ ID NO: 9719 - DNA, 33 bp, homo sapien
cccacctgtgatgatgkccctgagttgtgaaga

SEQ ID NO: 9720 - DNA, 33 bp, homo sapien
cttgcacaaaaggattygatacactagtcagag

SEQ ID NO: 9721 - DNA, 33 bp, homo sapien
accaatacaacgggaakgataacagtcatacct

SEQ ID NO: 9722 - DNA, 33 bp, homo sapien
tgacttcctggcagatktatcctaaagaaaaat

SEQ ID NO: 9723 - DNA, 33 bp, homo sapien
aagagctgtctattggmagaagatgccttgtag

SEQ ID NO: 9724 - DNA, 33 bp, homo sapien
ggtgaggaaaggatgawtacatttttcgggctt

SEQ ID NO: 9725 - DNA, 33 bp, homo sapien
ttatcatttctttctcrtcttagatgcttcctt

SEQ ID NO: 9726 - DNA, 33 bp, homo sapien
cattaaagctgtttgtmggcatcgtacgaaaaa

SEQ ID NO: 9727 - DNA, 33 bp, homo sapien
agattcggctaaagtcyacgagggccacgtatt

SEQ ID NO: 9728 - DNA, 33 bp, homo sapien
agaaaaatcgtataccytgtgatgaaaactaga

SEQ ID NO: 9729 - DNA, 33 bp, homo sapien
ccagcaccaatcagatyatgtatgtgttactca

SEQ ID NO: 9730 - DNA, 33 bp, homo sapien
tattttgcatcatttcytttgtattatcttttt

SEQ ID NO: 9731 - DNA, 33 bp, homo sapien
atataagtatggtaccmagaagaaatatctgca

SEQ ID NO: 9732 - DNA, 33 bp, homo sapien
tgcttctcatgaaagaytccaacaaggcaggaa

SEQ ID NO: 9733 - DNA, 33 bp, homo sapien
aatactgaatttctttwcttaatctcagaactc

SEQ ID NO: 9734 - DNA, 33 bp, homo sapien
gaacgtcgtatgttctrtgaagagccacactct

SEQ ID NO: 9735 - DNA, 33 bp, homo sapien
tctcatcaggttactgrgactatgtgagctttt

SEQ ID NO: 9736 - DNA, 33 bp, homo sapien
tggtgatttccttttgwgttcttggcattgatt

SEQ ID NO: 9737 - DNA, 33 bp, homo sapien
agcaccctctttgactyattaatgctgcatctg

SEQ ID NO: 9738 - DNA, 33 bp, homo sapien
cacatatattttcttcrggccagctactctact

SEQ ID NO: 9739 - DNA, 33 bp, homo sapien
tccagaaaactgaaacrtctgtactgtaaaggc

SEQ ID NO: 9740 - DNA, 33 bp, homo sapien
tttggtattgtcaggayttggattctagccata

SEQ ID NO: 9741 - DNA, 33 bp, homo sapien
ggagaaatgactcaaasaaagttaaataaaagg

SEQ ID NO: 9742 - DNA, 33 bp, homo sapien
actggatactcaaactkttcttaggaaattcac

SEQ ID NO: 9743 - DNA, 33 bp, homo sapien
ttgaccagataatttaygctaacaatatgattc

SEQ ID NO: 9744 - DNA, 33 bp, homo sapien
cggaaaatccacctaascaagaaggctgcttgg

SEQ ID NO: 9745 - DNA, 33 bp, homo sapien
catagctagaaattcamgactagagacgaggtc

SEQ ID NO: 9746 - DNA, 33 bp, homo sapien
aggaaaactataacttrtctcccagcctttctc

SEQ ID NO: 9747 - DNA, 33 bp, homo sapien
tcctgtttgacagacartcattcagaccacagc

SEQ ID NO: 9748 - DNA, 33 bp, homo sapien
cacatggtgacgagtgmatggctcaattctcaa

SEQ ID NO: 9749 - DNA, 33 bp, homo sapien
ggagacccataagagcsaataatgtagttccag

SEQ ID NO: 9750 - DNA, 33 bp, homo sapien
caaatgtagagccagtraaacattacaatctga

SEQ ID NO: 9751 - DNA, 33 bp, homo sapien
ccttgagtttgggcagkacttgtttattgttat

SEQ ID NO: 9752 - DNA, 33 bp, homo sapien
ccatctcaattacaccractccatctgtttagt

SEQ ID NO: 9753 - DNA, 33 bp, homo sapien
cagagaaggttctctgyagaacaaggcagatct

SEQ ID NO: 9754 - DNA, 33 bp, homo sapien
aaatattgtccttttamgttttttgatatacgt

SEQ ID NO: 9755 - DNA, 33 bp, homo sapien
caggccctgcttagtcmtcattagtgcatttca

SEQ ID NO: 9756 - DNA, 33 bp, homo sapien
tttcacataatgatgayagaattaagttgttgg

SEQ ID NO: 9757 - DNA, 33 bp, homo sapien
aaatatcatttcttctsattaaatctcctgcat

SEQ ID NO: 9758 - DNA, 33 bp, homo sapien
tccctttcaagaggaaygcataaataggtccca

SEQ ID NO: 9759 - DNA, 33 bp, homo sapien
tttttggatttgtgaamgatggctataggagaa

SEQ ID NO: 9760 - DNA, 33 bp, homo sapien
ataatcatcatcatccygcaaacaattaaatat

SEQ ID NO: 9761 - DNA, 33 bp, homo sapien
ctgccaccaactccctrgattatgttgaggatt

SEQ ID NO: 9762 - DNA, 33 bp, homo sapien
gggtaaatctgagtcastgattgatgtaaactt

SEQ ID NO: 9763 - DNA, 33 bp, homo sapien
tcaaaagtgtggttcamctatgtgagatgaatg

SEQ ID NO: 9764 - DNA, 33 bp, homo sapien
tttcagtgtagatcgamcagccttctgctggaa

SEQ ID NO: 9765 - DNA, 33 bp, homo sapien
tatcccaaaaaaaagakcatgaattcaaagagc

SEQ ID NO: 9766 - DNA, 33 bp, homo sapien
ctcactgtttcctcacktggcagaaagggcaag

SEQ ID NO: 9767 - DNA, 33 bp, homo sapien
tctatcacagatttacmacactgtattataaca

SEQ ID NO: 9768 - DNA, 33 bp, homo sapien
cctaaaagtcattgctrgagaggctttaggatc

SEQ ID NO: 9769 - DNA, 33 bp, homo sapien
gcaacgcttacgtgttsatcccagtgtcctttt

SEQ ID NO: 9770 - DNA, 33 bp, homo sapien
gaagtgactctcattgygtgaattcaagtcaca

SEQ ID NO: 9771 - DNA, 33 bp, homo sapien
aaaaggtgaagactacrgtttacacacacacac

SEQ ID NO: 9772 - DNA, 33 bp, homo sapien
ccctttgacagcaaaayctggcctttcctgaat

SEQ ID NO: 9773 - DNA, 33 bp, homo sapien
gttgtaatatcccatgygtacttgcctaatttt

SEQ ID NO: 9774 - DNA, 33 bp, homo sapien
acagcgcctgagtccasagtgagtaattaatac

SEQ ID NO: 9775 - DNA, 33 bp, homo sapien
caacatgatttctttcmattgtattcctttcct

SEQ ID NO: 9776 - DNA, 33 bp, homo sapien
tcagattcatcagcaaktcttgatatttccaca

SEQ ID NO: 9777 - DNA, 33 bp, homo sapien
agtgtcccctgaaattygtatgttgaaacccta

SEQ ID NO: 9778 - DNA, 33 bp, homo sapien
aacagtctgcatggctkgattcacagacccctt

SEQ ID NO: 9779 - DNA, 33 bp, homo sapien
tccacctgttgtatccyttgctgtgttcctcac

SEQ ID NO: 9780 - DNA, 33 bp, homo sapien
agaaattgctaatgaargatatgttgacttact

SEQ ID NO: 9781 - DNA, 33 bp, homo sapien
ataatctgatattgatyaccttattacctagac

SEQ ID NO: 9782 - DNA, 33 bp, homo sapien
gcttgaggagccttttygcagagtctttagggt

SEQ ID NO: 9783 - DNA, 33 bp, homo sapien
tactgccggattactgytgatactaccttaagg

SEQ ID NO: 9784 - DNA, 33 bp, homo sapien
actattttaaaacgagktaagagtttaagctta

SEQ ID NO: 9785 - DNA, 33 bp, homo sapien
ccaattaattgcctaaytgggtatgatgctgta

SEQ ID NO: 9786 - DNA, 33 bp, homo sapien
tatcaggagtatcagaygcatttatttcgcata

SEQ ID NO: 9787 - DNA, 33 bp, homo sapien
aaagtgagaaatctackctgccgcttacagcaa

SEQ ID NO: 9788 - DNA, 33 bp, homo sapien
gttcttgagggtggaargagagaaccctgctca

SEQ ID NO: 9789 - DNA, 33 bp, homo sapien
gaagggaaattcacaargggtacaatacatcga

SEQ ID NO: 9790 - DNA, 33 bp, homo sapien
ccagaagagagaactcyggacactctacaataa

SEQ ID NO: 9791 - DNA, 33 bp, homo sapien
attttataggcttaggytcaaaatactaccttt

SEQ ID NO: 9792 - DNA, 33 bp, homo sapien
tggctagtgtccttgarggttggtactctgctg

SEQ ID NO: 9793 - DNA, 33 bp, homo sapien
cacttgcttttctgttrcatctatctgtaccta

SEQ ID NO: 9794 - DNA, 33 bp, homo sapien
gtatcttctcaatttcmagccacctgccaaatt

SEQ ID NO: 9795 - DNA, 33 bp, homo sapien
agattttgtggatcatrggcccccagcaagggg

SEQ ID NO: 9796 - DNA, 33 bp, homo sapien
gaagaagacacagggamtatccccttctctttc

SEQ ID NO: 9797 - DNA, 33 bp, homo sapien
ggtcttcctgttcttcyctacacctgcttttgg

SEQ ID NO: 9798 - DNA, 33 bp, homo sapien
tttactattgctatatstctttcctcattgacc

SEQ ID NO: 9799 - DNA, 33 bp, homo sapien
gaattcagcagtgatgycattgggtactaggct

SEQ ID NO: 9800 - DNA, 33 bp, homo sapien
taagtgagatggatatrcctaacagttgacaga

SEQ ID NO: 9801 - DNA, 33 bp, homo sapien
agactatacaaaactcmatacccttcaatggct

SEQ ID NO: 9802 - DNA, 33 bp, homo sapien
ctctggctgatttgttkcctcttttctccagat

SEQ ID NO: 9803 - DNA, 33 bp, homo sapien
ccttgttattttcttcygacctcatatctcact

SEQ ID NO: 9804 - DNA, 33 bp, homo sapien
tatgaaagtgaaagacrgaaacagatattctat

SEQ ID NO: 9805 - DNA, 33 bp, homo sapien
cacatgatcaaatacamacagatggaaagctaa

SEQ ID NO: 9806 - DNA, 33 bp, homo sapien
aagagagaggagctcakggcttggcagcatgta

SEQ ID NO: 9807 - DNA, 33 bp, homo sapien
ctccctggaactgatawtttgaacaagacagcc

SEQ ID NO: 9808 - DNA, 33 bp, homo sapien
gtcccctctccacatgracacctgttatgctct

SEQ ID NO: 9809 - DNA, 33 bp, homo sapien
aagttgtgaggattggmatagaatatgggcatc

SEQ ID NO: 9810 - DNA, 33 bp, homo sapien
tagaatttagtagtgaygccattaggtcttggg

SEQ ID NO: 9811 - DNA, 33 bp, homo sapien
cagtttatatggcaaargattataagtacacta

SEQ ID NO: 9812 - DNA, 33 bp, homo sapien
aagtggatgaaaacaargtgtggattgggagaa

SEQ ID NO: 9813 - DNA, 33 bp, homo sapien
catatctagtttatccmttattctgaataagag

SEQ ID NO: 9814 - DNA, 33 bp, homo sapien
ggaaggcgttttattcrcatcagttgttttgca

SEQ ID NO: 9815 - DNA, 33 bp, homo sapien
cttgattgcttgcctcrtaagacttccaaggta

SEQ ID NO: 9816 - DNA, 33 bp, homo sapien
cttccttggattgactragtgtttatgatcttc

SEQ ID NO: 9817 - DNA, 33 bp, homo sapien
caccactttaatctacrtaacactggaagtcct

SEQ ID NO: 9818 - DNA, 33 bp, homo sapien
ctaaggaggattaggtyaaaaccaacagcatag

SEQ ID NO: 9819 - DNA, 33 bp, homo sapien
ttcgagttaatacggayatgttctgaaattcta

SEQ ID NO: 9820 - DNA, 33 bp, homo sapien
atgtagggaggcacacycattccacattgccaa

SEQ ID NO: 9821 - DNA, 33 bp, homo sapien
acataaagaggattttrttaaacgtattcacag

SEQ ID NO: 9822 - DNA, 33 bp, homo sapien
caataccaggaaccagrcagcagaagaaaaggt

SEQ ID NO: 9823 - DNA, 33 bp, homo sapien
atgcatttggctccaakagagatgaagccacat

SEQ ID NO: 9824 - DNA, 33 bp, homo sapien
catttaaacattgtctytgctgggtgtgatatc

SEQ ID NO: 9825 - DNA, 33 bp, homo sapien
cagggtaactttaattyttcctacttgacttgt

SEQ ID NO: 9826 - DNA, 33 bp, homo sapien
gactacattcatccagmtaaaaactaccttgaa

SEQ ID NO: 9827 - DNA, 33 bp, homo sapien
tgaaaagtagtctctayaaacacagggtaggct

SEQ ID NO: 9828 - DNA, 33 bp, homo sapien
actggactcctttcttrttataccacatgcaaa

SEQ ID NO: 9829 - DNA, 33 bp, homo sapien
cattttgtcttctaccrcctgtatcattttatt

SEQ ID NO: 9830 - DNA, 33 bp, homo sapien
aatcatctgttcatatrtctgcttcccattctc

SEQ ID NO: 9831 - DNA, 33 bp, homo sapien
tggattagaagaggagwttctgacacagacaca

SEQ ID NO: 9832 - DNA, 33 bp, homo sapien
acctactatatgccaawtactgtgaagtgttgg

SEQ ID NO: 9833 - DNA, 33 bp, homo sapien
aagagacagacggaacraaagcccacagctttg

SEQ ID NO: 9834 - DNA, 33 bp, homo sapien
ccaatacctgctatttkctgtttgtcttttata

SEQ ID NO: 9835 - DNA, 33 bp, homo sapien
ccctgtgcagtgccacrtttcacaggtcaaaga

SEQ ID NO: 9836 - DNA, 33 bp, homo sapien
cactccaaaaatccaasttcctaaacaccagcc

SEQ ID NO: 9837 - DNA, 33 bp, homo sapien
aggtcctagtagaaggygcttaccatatttcag

SEQ ID NO: 9838 - DNA, 33 bp, homo sapien
tgttctcagtggtccaygtgctacaactgagag

SEQ ID NO: 9839 - DNA, 33 bp, homo sapien
ggtgggatgttacttgraagagtttcagaaaag

SEQ ID NO: 9840 - DNA, 33 bp, homo sapien
aataatccacacctagmagaggaaaagctagtg

SEQ ID NO: 9841 - DNA, 33 bp, homo sapien
tttgtacattaattcarcaagcacatattgaac

SEQ ID NO: 9842 - DNA, 33 bp, homo sapien
tttgcaggcatgaaagmaaaggcctggaaaggt

SEQ ID NO: 9843 - DNA, 33 bp, homo sapien
tcagagagagatcaagrtaaaacgaaaaactca

SEQ ID NO: 9844 - DNA, 33 bp, homo sapien
agcccactgcattgtcraacctgaattccaagc

SEQ ID NO: 9845 - DNA, 33 bp, homo sapien
tgacaggaagaagaaaytgcagagtccctgcct

SEQ ID NO: 9846 - DNA, 33 bp, homo sapien
ataaaatcaaaggattsttgtcttcattattat

SEQ ID NO: 9847 - DNA, 33 bp, homo sapien
gttcagcttaccaggaytttaaactctttctta

SEQ ID NO: 9848 - DNA, 33 bp, homo sapien
agcttgccttccaccayacagtctgtagcttct

SEQ ID NO: 9849 - DNA, 33 bp, homo sapien
tcaaagcaaagaacaaygaagtagttgagattt

SEQ ID NO: 9850 - DNA, 33 bp, homo sapien
gcaaaagaatgtcaaamacggtatctgacacta

SEQ ID NO: 9851 - DNA, 33 bp, homo sapien
ggctaagtttctcattyctctggctctgtctcc

SEQ ID NO: 9852 - DNA, 33 bp, homo sapien
ggatagaaagaattagktaatgtggccatactg

SEQ ID NO: 9853 - DNA, 33 bp, homo sapien
ccacccagaaaagcatyagatctgggaaaaggg

SEQ ID NO: 9854 - DNA, 33 bp, homo sapien
aaccagtttcctcacasggcaccatggctgtag

SEQ ID NO: 9855 - DNA, 33 bp, homo sapien
ttctgaaaaagtcatcsggtcctttgtcactaa

SEQ ID NO: 9856 - DNA, 33 bp, homo sapien
aggttgtggcaaggatkggactctgctctgagg

SEQ ID NO: 9857 - DNA, 33 bp, homo sapien
agctatggaaaaaagtkagtgagctataatagg

SEQ ID NO: 9858 - DNA, 33 bp, homo sapien
agccaggcgctgttgamtctgagtccccactgg

SEQ ID NO: 9859 - DNA, 33 bp, homo sapien
tctggcaagtttttatyaggccttcctccttta

SEQ ID NO: 9860 - DNA, 33 bp, homo sapien
ctgtttttgtttagtawtgatgccttgcagtcc

SEQ ID NO: 9861 - DNA, 33 bp, homo sapien
cgaatttgtttccttargctcttaactactaag

SEQ ID NO: 9862 - DNA, 33 bp, homo sapien
gaatgatttttaacagyaagaaattaacaaagg

SEQ ID NO: 9863 - DNA, 33 bp, homo sapien
ggaccacaaccatgtcrccttactttgccccat

SEQ ID NO: 9864 - DNA, 33 bp, homo sapien
ctccagcactctgcagrcttcactttccccaaa

SEQ ID NO: 9865 - DNA, 33 bp, homo sapien
gggtgcctgtaccaagytggtccaatcagagtt

SEQ ID NO: 9866 - DNA, 33 bp, homo sapien
tgtagataataaacagyggtcagtttttgttaa

SEQ ID NO: 9867 - DNA, 33 bp, homo sapien
atttatatttagaattrtgatttgagctttttc

SEQ ID NO: 9868 - DNA, 33 bp, homo sapien
taggatgctaggtcagygatcagcaccaaatag

SEQ ID NO: 9869 - DNA, 33 bp, homo sapien
ctgagggaggaacagtsacttctggtcctgacc

SEQ ID NO: 9870 - DNA, 33 bp, homo sapien
tagttttaatgttttgkgataaatatggcataa

SEQ ID NO: 9871 - DNA, 33 bp, homo sapien
gtctcagatgcctattktattaccgagagagta

SEQ ID NO: 9872 - DNA, 33 bp, homo sapien
aagattcagatagttgyagagaggtggagatag

SEQ ID NO: 9873 - DNA, 33 bp, homo sapien
aaggagcagtaggcctrgcaaggagagagagga

SEQ ID NO: 9874 - DNA, 33 bp, homo sapien
gtgatggtgacgtgtcmttgtgggttcatcagc

SEQ ID NO: 9875 - DNA, 33 bp, homo sapien
tcctattgactaggtcygtgttaagtgtattct

SEQ ID NO: 9876 - DNA, 33 bp, homo sapien
gtctttccttgagtgaytgacctctcttagcct

SEQ ID NO: 9877 - DNA, 33 bp, homo sapien
aaaacaataatgagtgrcatgcctttgatagta

SEQ ID NO: 9878 - DNA, 33 bp, homo sapien
caattgcacaggacaarctcaatcatgtcccag

SEQ ID NO: 9879 - DNA, 33 bp, homo sapien
actttgggcaaatagcytaccctttctcatcct

SEQ ID NO: 9880 - DNA, 33 bp, homo sapien
tgaggctttctcatcayggcttctatgggggca

SEQ ID NO: 9881 - DNA, 33 bp, homo sapien
agtacaaattgtggttsttgaattgtctaaatt

SEQ ID NO: 9882 - DNA, 33 bp, homo sapien
agtagtttggacacaayagaagaaataatcagt

SEQ ID NO: 9883 - DNA, 33 bp, homo sapien
tcgtagtgatttttgcytcctacttagctagat

SEQ ID NO: 9884 - DNA, 33 bp, homo sapien
agctacaccaagaacaygcttccttgtagctcc

SEQ ID NO: 9885 - DNA, 33 bp, homo sapien
tcctgccagcgctactyggtgaccaaacccaac

SEQ ID NO: 9886 - DNA, 33 bp, homo sapien
gttcccaaatccaggtyctggctcctggaaagc

SEQ ID NO: 9887 - DNA, 33 bp, homo sapien
aaagaaagctcctgccrtgtgttcactctattt

SEQ ID NO: 9888 - DNA, 33 bp, homo sapien
ctggaacagacagtatytatcaacagggcaaca

SEQ ID NO: 9889 - DNA, 33 bp, homo sapien
aggattgcaaaacaccwgtcacagccatgttct

SEQ ID NO: 9890 - DNA, 33 bp, homo sapien
tgtctcattttatactsctactaacagtgcaca

SEQ ID NO: 9891 - DNA, 33 bp, homo sapien
gatgccctgcctggtgygaccttagctcatttg

SEQ ID NO: 9892 - DNA, 33 bp, homo sapien
cacttctcaataccttwtctaaatgccaatctc

SEQ ID NO: 9893 - DNA, 33 bp, homo sapien
agatactttcttactcycttgacggtggctgtg

SEQ ID NO: 9894 - DNA, 33 bp, homo sapien
ctcctgctgtcaaatgytttagggctgtcccag

SEQ ID NO: 9895 - DNA, 33 bp, homo sapien
gagaagagtgctgggtkgtatgaaactgacaag

SEQ ID NO: 9896 - DNA, 33 bp, homo sapien
attgtaaatcttttttyggacaaagggtaaaga

SEQ ID NO: 9897 - DNA, 33 bp, homo sapien
aaattaggactcatttrtctatttatatatact

SEQ ID NO: 9898 - DNA, 33 bp, homo sapien
tccaccaatcaagaggkacatgagaatttgctt

SEQ ID NO: 9899 - DNA, 33 bp, homo sapien
aaaaaaaaggagtttcyctcaaacagcagttaa

SEQ ID NO: 9900 - DNA, 33 bp, homo sapien
attgtgcttctttggtrttatcagagctttaaa

SEQ ID NO: 9901 - DNA, 33 bp, homo sapien
ctggagaggaatgaacmagagtttaagagatgg

SEQ ID NO: 9902 - DNA, 33 bp, homo sapien
tgcaggctcctgagaawaaattccacaaatgtc

SEQ ID NO: 9903 - DNA, 33 bp, homo sapien
tggttttcttcaggacragcaagacagcaagag

SEQ ID NO: 9904 - DNA, 33 bp, homo sapien
tagtcatgccttagaayatgcccatgaacaatc

SEQ ID NO: 9905 - DNA, 33 bp, homo sapien
ccaccaagtattgcagycaggaaatgaataaag

SEQ ID NO: 9906 - DNA, 33 bp, homo sapien
ttcccccagagagttayaatggtgaaaaaaggg

SEQ ID NO: 9907 - DNA, 33 bp, homo sapien
ggtagagagacaactgsatcctaagtactaatt

SEQ ID NO: 9908 - DNA, 33 bp, homo sapien
atgtcaattctgttgtwcttacatggagtcttc

SEQ ID NO: 9909 - DNA, 33 bp, homo sapien
aaccagaaggaacctcrgcaaattttttagaca

SEQ ID NO: 9910 - DNA, 33 bp, homo sapien
aagatagatgtttggaygaccatgaaaatttga

SEQ ID NO: 9911 - DNA, 33 bp, homo sapien
gcctgcagtttttgttmctattgtttattaatg

SEQ ID NO: 9912 - DNA, 33 bp, homo sapien
gtggaataaggtgaaayagaaacagatcatcct

SEQ ID NO: 9913 - DNA, 33 bp, homo sapien
attaaaagctgagagtkaatgaataaacagata

SEQ ID NO: 9914 - DNA, 33 bp, homo sapien
agactaagaagccatartaactgaaggccttgt

SEQ ID NO: 9915 - DNA, 33 bp, homo sapien
aacctgcccagtattgyttggttggagcatttt

SEQ ID NO: 9916 - DNA, 33 bp, homo sapien
ctcagtcatgactatcrgtaatttacacccccc

SEQ ID NO: 9917 - DNA, 33 bp, homo sapien
ccttcctccttctttcrttcgtttttgggtggc

SEQ ID NO: 9918 - DNA, 33 bp, homo sapien
cagaccaacaagctttsacattgaatcagtaat

SEQ ID NO: 9919 - DNA, 33 bp, homo sapien
ttgtgcggccaagatgmattttgaggaactaac

SEQ ID NO: 9920 - DNA, 33 bp, homo sapien
gggtctccctgctttgygtcttgtgctctggta

SEQ ID NO: 9921 - DNA, 33 bp, homo sapien
ctcctttatgaatcttwctttaatttctccccc

SEQ ID NO: 9922 - DNA, 33 bp, homo sapien
cctgttctcaacttttmactccaccctttctct

SEQ ID NO: 9923 - DNA, 33 bp, homo sapien
aaaagaaggcatgaagrcatttatgtggtcaac

SEQ ID NO: 9924 - DNA, 33 bp, homo sapien
tttgagtttcttaaatwggtaggtattgaagtc

SEQ ID NO: 9925 - DNA, 33 bp, homo sapien
ttctttttcagcagtcwttttcttcaattaatt

SEQ ID NO: 9926 - DNA, 33 bp, homo sapien
gactcaagtatctggtraagtgacaaaaatgta

SEQ ID NO: 9927 - DNA, 33 bp, homo sapien
aatctaaccattgaccrtattggacatgaacaa

SEQ ID NO: 9928 - DNA, 33 bp, homo sapien
ggggttggggagaagaygcaatagctctgtttt

SEQ ID NO: 9929 - DNA, 33 bp, homo sapien
tctatcctttaaactcrgaatttataactcaca

SEQ ID NO: 9930 - DNA, 33 bp, homo sapien
taggctgtgcacattaytccagaactgttattc

SEQ ID NO: 9931 - DNA, 33 bp, homo sapien
ttttttaggtctacaarcactgaatgagcacct

SEQ ID NO: 9932 - DNA, 33 bp, homo sapien
tggacaaagaacaggaktacccaggaacatgac

SEQ ID NO: 9933 - DNA, 33 bp, homo sapien
cacggccaagataaaaratcccaggccctggac

SEQ ID NO: 9934 - DNA, 33 bp, homo sapien
ctaactttctgaaccarctaacgatggcatgga

SEQ ID NO: 9935 - DNA, 33 bp, homo sapien
gagtgttcattcttacyctcagtgcacagaagc

SEQ ID NO: 9936 - DNA, 33 bp, homo sapien
taaaatatgagcatcaraaaagatggactgttg

SEQ ID NO: 9937 - DNA, 33 bp, homo sapien
acccattggacactacyaatttcatgtattttc

SEQ ID NO: 9938 - DNA, 33 bp, homo sapien
acagaaagagggaaggmcatgataggatccata

SEQ ID NO: 9939 - DNA, 33 bp, homo sapien
acagaagctactgaaamactgatttctaaagat

SEQ ID NO: 9940 - DNA, 33 bp, homo sapien
tcattgcccctattcarccttaagaagctacag

SEQ ID NO: 9941 - DNA, 33 bp, homo sapien
gtgctgctacaagccargaacacctgaggctac

SEQ ID NO: 9942 - DNA, 33 bp, homo sapien
tctctttggtggaaacrttgctaacactgcata

SEQ ID NO: 9943 - DNA, 33 bp, homo sapien
acaagtgtaatgaaaayaattctggtactggtg

SEQ ID NO: 9944 - DNA, 33 bp, homo sapien
acctggatgttttcaartagtcgcatttttagc

SEQ ID NO: 9945 - DNA, 33 bp, homo sapien
acattcaagcccttackaacaaaagatggaccc

SEQ ID NO: 9946 - DNA, 33 bp, homo sapien
cctcctgtttaagaaawgtttgcctatgtaaag

SEQ ID NO: 9947 - DNA, 33 bp, homo sapien
agattctttcctaagayatttcaacatgtgatc

SEQ ID NO: 9948 - DNA, 33 bp, homo sapien
caacagtgacataaaayggaaatataagtcctt

SEQ ID NO: 9949 - DNA, 33 bp, homo sapien
acaccactgcactccawcaaacagagccagact

SEQ ID NO: 9950 - DNA, 33 bp, homo sapien
gagcccctagagcaagkaaaagttataaatcta

SEQ ID NO: 9951 - DNA, 33 bp, homo sapien
caaccaccagctgggargaagatgacccccaag

SEQ ID NO: 9952 - DNA, 33 bp, homo sapien
ttcaaaaaaggaataartacctatcaaagtgag

SEQ ID NO: 9953 - DNA, 33 bp, homo sapien
agtatacactggagacygaaaccatgatgaagt

SEQ ID NO: 9954 - DNA, 33 bp, homo sapien
ctccagaaatgatgttkgtatcactacttacaa

SEQ ID NO: 9955 - DNA, 33 bp, homo sapien
tgaacagacaatttgcraaagaagatatttatg

SEQ ID NO: 9956 - DNA, 33 bp, homo sapien
gggacagtcttgaatcrccaatgccaccactcc

SEQ ID NO: 9957 - DNA, 33 bp, homo sapien
agaatagcctcatggtytgcttgtcctccagat

SEQ ID NO: 9958 - DNA, 33 bp, homo sapien
acatctcttttgagctwgtttttatatcctctg

SEQ ID NO: 9959 - DNA, 33 bp, homo sapien
caatatgacatctatayacacaaagagtatgac

SEQ ID NO: 9960 - DNA, 33 bp, homo sapien
cacccagatcttcacckgactggcttcctcttt

SEQ ID NO: 9961 - DNA, 33 bp, homo sapien
tctttaatttacttgtrgcacagacatgctcca

SEQ ID NO: 9962 - DNA, 33 bp, homo sapien
tacactcagctcaagtyttcactgaccccaagt

SEQ ID NO: 9963 - DNA, 33 bp, homo sapien
ccgctaaagtctgtacycagctacctcagtgtt

SEQ ID NO: 9964 - DNA, 33 bp, homo sapien
cctcaagacttgctcamcttagacatgcattct

SEQ ID NO: 9965 - DNA, 33 bp, homo sapien
tgggttgttcttatttsttgcttgtgttgggtg

SEQ ID NO: 9966 - DNA, 33 bp, homo sapien
accacaaggctatgacrtaattcttggttgcct

SEQ ID NO: 9967 - DNA, 33 bp, homo sapien
ctccactttggcttttwacaacatggtagaaca

SEQ ID NO: 9968 - DNA, 33 bp, homo sapien
tgattactttcttcttyggtgccaattagaatc

SEQ ID NO: 9969 - DNA, 33 bp, homo sapien
cttccagatatttgacrtggcttcctccttcac

SEQ ID NO: 9970 - DNA, 33 bp, homo sapien
tgactgacataatctcmttgcaatattgttgag

SEQ ID NO: 9971 - DNA, 33 bp, homo sapien
ctgccaatgtaacagcragctctgctttccctt

SEQ ID NO: 9972 - DNA, 33 bp, homo sapien
tatacaagatttgaaargaaattgtggaaattt

SEQ ID NO: 9973 - DNA, 33 bp, homo sapien
tccaaatatggttgatyctaaattgaccagtta

SEQ ID NO: 9974 - DNA, 33 bp, homo sapien
atctcagctaagagackaagaccatccctcctc

SEQ ID NO: 9975 - DNA, 33 bp, homo sapien
tcttatatgtgatagaktagtgaagaatttaag

SEQ ID NO: 9976 - DNA, 33 bp, homo sapien
agctgtggtttgctttrtggatgagcttagcat

SEQ ID NO: 9977 - DNA, 33 bp, homo sapien
aatctgttgggactgcmataaaacatgacttag

SEQ ID NO: 9978 - DNA, 33 bp, homo sapien
tcttcatgggtcccacrtgcaaattcaaaggga

SEQ ID NO: 9979 - DNA, 33 bp, homo sapien
ctgaaaacaaagtttcrgcatcacttatctagc

SEQ ID NO: 9980 - DNA, 33 bp, homo sapien
ttaaaatgagcattttsttttgccaaaaataat

SEQ ID NO: 9981 - DNA, 33 bp, homo sapien
agctttcccccagtccwtgctgcaaccacaaag

SEQ ID NO: 9982 - DNA, 33 bp, homo sapien
agtgggaagtcaggccrgcagtctgaaaatagc

SEQ ID NO: 9983 - DNA, 33 bp, homo sapien
ttatgaagcaagtctcrcaattcaaggtgacca

SEQ ID NO: 9984 - DNA, 33 bp, homo sapien
ctaggcatatactcatstgtacaaacaaggcct

SEQ ID NO: 9985 - DNA, 33 bp, homo sapien
ggggcaagggaactgaygagtcttgggtgcaaa

SEQ ID NO: 9986 - DNA, 33 bp, homo sapien
aaataatagaattagckaaacagaaaagtatct

SEQ ID NO: 9987 - DNA, 33 bp, homo sapien
tctgttgaattttctcytttgtttcagtggttg

SEQ ID NO: 9988 - DNA, 33 bp, homo sapien
tgaatcatgtccagtargagacaaggactgcga

SEQ ID NO: 9989 - DNA, 33 bp, homo sapien
ccaagtaatgaccacartgcagtctgttacgac

SEQ ID NO: 9990 - DNA, 33 bp, homo sapien
atccagagcaatagtcratgcatagcatactat

SEQ ID NO: 9991 - DNA, 33 bp, homo sapien
acagccagcaaggaaaygagggccactatgcta

SEQ ID NO: 9992 - DNA, 33 bp, homo sapien
gaaaacaccactttctytcttacctcttgttca

SEQ ID NO: 9993 - DNA, 33 bp, homo sapien
tgcgtatttgcattgcrtcttctttgattgcct

SEQ ID NO: 9994 - DNA, 33 bp, homo sapien
aaaacagaagtggatgwgcagtaaaatgacttt

SEQ ID NO: 9995 - DNA, 33 bp, homo sapien
cttccagtaatgtccamgtaatcaacatgagac

SEQ ID NO: 9996 - DNA, 33 bp, homo sapien
ggcattggacaaaagaygataatgtttatttag

SEQ ID NO: 9997 - DNA, 33 bp, homo sapien
tttatgtgatgggttaygttaattgttttgcgt

SEQ ID NO: 9998 - DNA, 33 bp, homo sapien
taatggcattcgcaacytaagcccactctctcc

SEQ ID NO: 9999 - DNA, 33 bp, homo sapien
ttggaggctattttaayagtccaggtgaaaaat

SEQ ID NO: 10000 - DNA, 33 bp, homo sapien
ctaaaataccaactccrtcatatcttcagaaca

SEQ ID NO: 10001 - DNA, 33 bp, homo sapien
gaacggaatgagaagamccttacagtagccaac

SEQ ID NO: 10002 - DNA, 33 bp, homo sapien
aactccattcttgcagytgttcaggcagaaaac

SEQ ID NO: 10003 - DNA, 33 bp, homo sapien
ttacaaatgagggaacygaggtatagaaaggtt

SEQ ID NO: 10004 - DNA, 33 bp, homo sapien
gcagcccaggagagggmtttttttcttggtcat

SEQ ID NO: 10005 - DNA, 33 bp, homo sapien
cgaaagataccaaagayaaagttaacagacggg

SEQ ID NO: 10006 - DNA, 33 bp, homo sapien
ttttctcaaccaacatygaccctttgagcaggg

SEQ ID NO: 10007 - DNA, 33 bp, homo sapien
tctgggcaaagaaaatkaaagcacctttctgga

SEQ ID NO: 10008 - DNA, 33 bp, homo sapien
atgtgaatatttaaagrgttcttgtagggacct

SEQ ID NO: 10009 - DNA, 33 bp, homo sapien
gttctcactctggcaaratgggatgagttctca

SEQ ID NO: 10010 - DNA, 33 bp, homo sapien
gcctttggctcttggcygtagaagagcatgctt

SEQ ID NO: 10011 - DNA, 33 bp, homo sapien
ttaattacattggactrcttctatcatggaaaa

SEQ ID NO: 10012 - DNA, 33 bp, homo sapien
tacattcctccagatcyctgatacaaaagatca

SEQ ID NO: 10013 - DNA, 33 bp, homo sapien
tacagtttagctgaggmtcattctgctttatta

SEQ ID NO: 10014 - DNA, 33 bp, homo sapien
gcatcagcccatgcccwcttcaatctgttctca

SEQ ID NO: 10015 - DNA, 33 bp, homo sapien
attaacatttcagaagrtctcgtttaaacttcc

SEQ ID NO: 10016 - DNA, 33 bp, homo sapien
agtgaagtggctcttcscatggacagtccagtc

SEQ ID NO: 10017 - DNA, 33 bp, homo sapien
tatctttatgaccttgmgattgccagtgagttc

SEQ ID NO: 10018 - DNA, 33 bp, homo sapien
aggtatttcatgctgcyggccactgaaagcata

SEQ ID NO: 10019 - DNA, 33 bp, homo sapien
aatgtctccaaggcatrtcattgacctttgcag

SEQ ID NO: 10020 - DNA, 33 bp, homo sapien
tttgtgtgacttttgcmatgtgttgattcttta

SEQ ID NO: 10021 - DNA, 33 bp, homo sapien
caaaattctatgatgamcaatgaagagacaaca

SEQ ID NO: 10022 - DNA, 33 bp, homo sapien
gtattcttctgggcttktgattcctggtataaa

SEQ ID NO: 10023 - DNA, 33 bp, homo sapien
aaaaaaaatgctgagartgtaaaatactgggaa

SEQ ID NO: 10024 - DNA, 33 bp, homo sapien
ctttgctttgctttttstactagcatagagagc

SEQ ID NO: 10025 - DNA, 33 bp, homo sapien
ctttacaaggtagctawaattaagcacattttg

SEQ ID NO: 10026 - DNA, 33 bp, homo sapien
atctctcttagttcttygacctctctgactagt

SEQ ID NO: 10027 - DNA, 33 bp, homo sapien
atattttctctgactcrattatgtggaaagtgt

SEQ ID NO: 10028 - DNA, 33 bp, homo sapien
ttctcactctattgcayggaatatatagtattt

SEQ ID NO: 10029 - DNA, 33 bp, homo sapien
ctcagaaaaaaacatcmcttgacattcggactt

SEQ ID NO: 10030 - DNA, 33 bp, homo sapien
tgggaaagaccaaaaartcttacgaactgcact

SEQ ID NO: 10031 - DNA, 33 bp, homo sapien
cgaggcaacaggaactstcaggaactctcattt

SEQ ID NO: 10032 - DNA, 33 bp, homo sapien
gagtaactattgctcakttattctcattcatgt

SEQ ID NO: 10033 - DNA, 33 bp, homo sapien
gaacaagaaccagtgaraacataaacagactga

SEQ ID NO: 10034 - DNA, 33 bp, homo sapien
ttaatacaggttatttyccatggagcaaaattg

SEQ ID NO: 10035 - DNA, 33 bp, homo sapien
cacagtgctcagctgamcagcagtgagtgccag

SEQ ID NO: 10036 - DNA, 33 bp, homo sapien
ctccctcgttcagattygctccttgttcttcag

SEQ ID NO: 10037 - DNA, 33 bp, homo sapien
actcaagtgaacactcrgctcaaagtccattgc

SEQ ID NO: 10038 - DNA, 33 bp, homo sapien
aatttaagtacaggcarctaaagaatgatttgc

SEQ ID NO: 10039 - DNA, 33 bp, homo sapien
tagatacaaatacagawcaatctcaactcattg

SEQ ID NO: 10040 - DNA, 33 bp, homo sapien
tcttttcttctctgtgrttccaagtgttttgat

SEQ ID NO: 10041 - DNA, 33 bp, homo sapien
tacgcttgagaaactgraagggcatgagtcgtg

SEQ ID NO: 10042 - DNA, 33 bp, homo sapien
tagatgtccttttaaartctgatctgcaaaaag

SEQ ID NO: 10043 - DNA, 33 bp, homo sapien
ttttcatgcagtctaargataaaatgatattcc

SEQ ID NO: 10044 - DNA, 33 bp, homo sapien
gcagaggtggtgttctrtaaatattcattccct

SEQ ID NO: 10045 - DNA, 33 bp, homo sapien
tccatggtcagatctaygtaaacggaatcatct

SEQ ID NO: 10046 - DNA, 33 bp, homo sapien
ctgtttgggcttcgaaygtaactgacatctttg

SEQ ID NO: 10047 - DNA, 33 bp, homo sapien
ctaatccagaaagagasctgaaggtgggagaga

SEQ ID NO: 10048 - DNA, 33 bp, homo sapien
ggtgatagtctgactgkaatccccatgggcctg

SEQ ID NO: 10049 - DNA, 33 bp, homo sapien
cctcccagaaatccaasaaagaatggaaataat

SEQ ID NO: 10050 - DNA, 33 bp, homo sapien
cagagcaacataatgcktgaggcccagacctta

SEQ ID NO: 10051 - DNA, 33 bp, homo sapien
tgagtcattggctggaragagacaaggagtcat

SEQ ID NO: 10052 - DNA, 33 bp, homo sapien
gaatagatgtacagaawgctaattaaaagtttg

SEQ ID NO: 10053 - DNA, 33 bp, homo sapien
caccttttagaattcaraccattatctgcggtt

SEQ ID NO: 10054 - DNA, 33 bp, homo sapien
aggtgcaaaggacgatrtttgggagtggaaggc

SEQ ID NO: 10055 - DNA, 33 bp, homo sapien
agaaatgttgaaggacrtcagtcaatctttaat

SEQ ID NO: 10056 - DNA, 33 bp, homo sapien
ggggaactgtgttgggktctagcatgtattgtg

SEQ ID NO: 10057 - DNA, 33 bp, homo sapien
ctagtgctattagattmcaacacgtgggctcta

SEQ ID NO: 10058 - DNA, 33 bp, homo sapien
tacaggcgcgcatcacyatgcatagctaatttt

SEQ ID NO: 10059 - DNA, 33 bp, homo sapien
atgcagaaaggtcttgyctctaaagcccgctat

SEQ ID NO: 10060 - DNA, 33 bp, homo sapien
gatgcagagaaagggascttaaaaagatcatct

SEQ ID NO: 10061 - DNA, 33 bp, homo sapien
ccccttgttgcctccasggactatgaaggtgaa

SEQ ID NO: 10062 - DNA, 33 bp, homo sapien
atcaagggaaattcaasaggtgaaattagcatg

SEQ ID NO: 10063 - DNA, 33 bp, homo sapien
atcaataactggagccyaatagcttcattgggg

SEQ ID NO: 10064 - DNA, 33 bp, homo sapien
aaagcagttcaacagtsaaaagacaggtttatt

SEQ ID NO: 10065 - DNA, 33 bp, homo sapien
tttgtcaaagaactacrtaagcttctgaaatag

SEQ ID NO: 10066 - DNA, 33 bp, homo sapien
aaattggaaagacattycatgaacaaggattgg

SEQ ID NO: 10067 - DNA, 33 bp, homo sapien
aggtttgtgacagcaakctctaatcacacatat

SEQ ID NO: 10068 - DNA, 33 bp, homo sapien
tattatgtcaattccaygaaaaaaatatgctac

SEQ ID NO: 10069 - DNA, 33 bp, homo sapien
ccctctaaaagctgctrgtactacagagatgtg

SEQ ID NO: 10070 - DNA, 33 bp, homo sapien
ggttgtgcaggaggccrgctgccagtgcctggg

SEQ ID NO: 10071 - DNA, 33 bp, homo sapien
tgagattcatccactcyggttgatcagaatgcc

SEQ ID NO: 10072 - DNA, 33 bp, homo sapien
ccgtgcatcagaacagstggatccaagtattca

SEQ ID NO: 10073 - DNA, 33 bp, homo sapien
acatggtggtgacaagrtaaaataaggaagatg

SEQ ID NO: 10074 - DNA, 33 bp, homo sapien
accctcttacctttgaygtcagaggccacatca

SEQ ID NO: 10075 - DNA, 33 bp, homo sapien
ctctagttttatggtaycagagaatttgtgata

SEQ ID NO: 10076 - DNA, 33 bp, homo sapien
catacagaaacacaaawtgagggtgacaaaagt

SEQ ID NO: 10077 - DNA, 33 bp, homo sapien
gagttcctctgacaaaygtctctcagcattgat

SEQ ID NO: 10078 - DNA, 33 bp, homo sapien
gaatatgcaacaccaaragtgagccctaatgta

SEQ ID NO: 10079 - DNA, 33 bp, homo sapien
aagccattgccctgaaragaaggacccagtcct

SEQ ID NO: 10080 - DNA, 33 bp, homo sapien
tgaattgatttgaaggmgtcagacaggccgtgg

SEQ ID NO: 10081 - DNA, 33 bp, homo sapien
tgtttggaaaaagcagrctcgcagcacaatgct

SEQ ID NO: 10082 - DNA, 33 bp, homo sapien
ccaaatctagtcttcaytgtccttcttgtgata

SEQ ID NO: 10083 - DNA, 33 bp, homo sapien
aagcactaacactaccrcctcagtaaagctgtt

SEQ ID NO: 10084 - DNA, 33 bp, homo sapien
tgttttctcagaggttrttaataccagctgggc

SEQ ID NO: 10085 - DNA, 33 bp, homo sapien
aggatgagatgcatacwcctacttcctttttat

SEQ ID NO: 10086 - DNA, 33 bp, homo sapien
atgacattgtttctaaraattcattacttgcat

SEQ ID NO: 10087 - DNA, 33 bp, homo sapien
atgccttgaccaaacayggaaatagcaatgata

SEQ ID NO: 10088 - DNA, 33 bp, homo sapien
ctcataaaacaatctgmtttccttaccaaccca

SEQ ID NO: 10089 - DNA, 33 bp, homo sapien
tatgagtctgtgctttsataggccactctagtg

SEQ ID NO: 10090 - DNA, 33 bp, homo sapien
caaatggtctttttttycacaagaacatgagat

SEQ ID NO: 10091 - DNA, 33 bp, homo sapien
aacatattataacttckcctcaaaattcagtag

SEQ ID NO: 10092 - DNA, 33 bp, homo sapien
attgcataaaagaatawtttaaaacacctccaa

SEQ ID NO: 10093 - DNA, 33 bp, homo sapien
tgcatgattctttcttkcacccaagattttctc

SEQ ID NO: 10094 - DNA, 33 bp, homo sapien
gggctggtgaagtcatrggaacacaaggcctct

SEQ ID NO: 10095 - DNA, 33 bp, homo sapien
aattacagcaacattgycttccagtgtgcatct

SEQ ID NO: 10096 - DNA, 33 bp, homo sapien
cgagacaattcagagtkaaatgttgggcaagac

SEQ ID NO: 10097 - DNA, 33 bp, homo sapien
ggctcagagtttgacayacaataggcacttaat

SEQ ID NO: 10098 - DNA, 33 bp, homo sapien
tgtcatcgttgaatttscaacatctcacttttt

SEQ ID NO: 10099 - DNA, 33 bp, homo sapien
tccactgcatgtgctcrtgggacactaagctct

SEQ ID NO: 10100 - DNA, 33 bp, homo sapien
aagcagaatatttttargtcaaatggacaaaaa

SEQ ID NO: 10101 - DNA, 33 bp, homo sapien
gtcatgctttcagttaytttggataaatatcca

SEQ ID NO: 10102 - DNA, 33 bp, homo sapien
cttaataaagaattacrcaaacaaactgatctt

SEQ ID NO: 10103 - DNA, 33 bp, homo sapien
ctatagatatcctcacrgtactcattctcctta

SEQ ID NO: 10104 - DNA, 33 bp, homo sapien
agtgtttgagtacctgwtgtaccagcagccaga

SEQ ID NO: 10105 - DNA, 33 bp, homo sapien
caagagcctcggagacwatttgtaggtgcaggg

SEQ ID NO: 10106 - DNA, 33 bp, homo sapien
ccccagatgctttctgstctatctttaggtttt

SEQ ID NO: 10107 - DNA, 33 bp, homo sapien
ctaatatacattcctascatctgtgtaaaagcc

SEQ ID NO: 10108 - DNA, 33 bp, homo sapien
taacagattgagacagwaagagagaatgggaat

SEQ ID NO: 10109 - DNA, 33 bp, homo sapien
ttaggaataattcagaygatcttaataggtgtg

SEQ ID NO: 10110 - DNA, 33 bp, homo sapien
atccaattagaaaaccrgtagtaggcaaaacca

SEQ ID NO: 10111 - DNA, 33 bp, homo sapien
tgtaacccccttggtaragctacctgagaatcc

SEQ ID NO: 10112 - DNA, 33 bp, homo sapien
tctaattgagattaatkgaattgtctctcttct

SEQ ID NO: 10113 - DNA, 33 bp, homo sapien
agctgccatagatagtratgcctgtgatggatc

SEQ ID NO: 10114 - DNA, 33 bp, homo sapien
agagggacaatgggacyacataattgaagttgg

SEQ ID NO: 10115 - DNA, 33 bp, homo sapien
tctcttaatgtgggtgyttgctctcttcaggtg

SEQ ID NO: 10116 - DNA, 33 bp, homo sapien
catttgtgagtaatcaracagttgataaaagaa

SEQ ID NO: 10117 - DNA, 33 bp, homo sapien
cagtttttgatgggacwtggctgcctagaataa

SEQ ID NO: 10118 - DNA, 33 bp, homo sapien
acaccaaattgtacaastatccatgcaaaagac

SEQ ID NO: 10119 - DNA, 33 bp, homo sapien
tcacattcagattgttkgtaagaggaattccaa

SEQ ID NO: 10120 - DNA, 33 bp, homo sapien
aactcaaggctacatamgacctagatatgctct

SEQ ID NO: 10121 - DNA, 33 bp, homo sapien
attagggtgggtgtccraactggtggtgttagt

SEQ ID NO: 10122 - DNA, 33 bp, homo sapien
cagaaacatgtgtagamgtctccttggtttttt

SEQ ID NO: 10123 - DNA, 33 bp, homo sapien
ggagcaagtgtatgaarttctgaaggaagggct

SEQ ID NO: 10124 - DNA, 33 bp, homo sapien
gaggcagtgctcctttygcgagggcattagctg

SEQ ID NO: 10125 - DNA, 33 bp, homo sapien
ctgtaggttgtctcttsaatctgttggttgttt

SEQ ID NO: 10126 - DNA, 33 bp, homo sapien
atgcccaggtaaaagargaccagtagaatcttg

SEQ ID NO: 10127 - DNA, 33 bp, homo sapien
ttatatgctgtgtaagkcctgttcctctttccc

SEQ ID NO: 10128 - DNA, 33 bp, homo sapien
accctctatattcgaayggtctgggttaggagc

SEQ ID NO: 10129 - DNA, 33 bp, homo sapien
ggaattttgctctatakccccgacagctggtag

SEQ ID NO: 10130 - DNA, 33 bp, homo sapien
atttaaaagctgaagtwgtaattcaacacaatc

SEQ ID NO: 10131 - DNA, 33 bp, homo sapien
ggagccccatttccacrgaattgtcattatttg

SEQ ID NO: 10132 - DNA, 33 bp, homo sapien
attgtgacttctcttakggagcacacttgcctt

SEQ ID NO: 10133 - DNA, 33 bp, homo sapien
aggcattcctggaaaaytcagtgtacattaaac

SEQ ID NO: 10134 - DNA, 33 bp, homo sapien
atcagtatacatagagycttgtaaaccttggta

SEQ ID NO: 10135 - DNA, 33 bp, homo sapien
caagacagaaacaaagsaaaagtatctatctct

SEQ ID NO: 10136 - DNA, 33 bp, homo sapien
agatgtacctactgcawatggcttctcctcaca

SEQ ID NO: 10137 - DNA, 33 bp, homo sapien
gaaggaaacaacaaagrccctagtccaccttaa

SEQ ID NO: 10138 - DNA, 33 bp, homo sapien
tcttaaattctactgcraacgtgtgaaatgacg

SEQ ID NO: 10139 - DNA, 33 bp, homo sapien
gatctcatgacaattcyctgacttctctccaga

SEQ ID NO: 10140 - DNA, 33 bp, homo sapien
attatgaaaaaatccgragactccatcctttat

SEQ ID NO: 10141 - DNA, 33 bp, homo sapien
agcaccacctcttctayaacgcagtactcttgc

SEQ ID NO: 10142 - DNA, 33 bp, homo sapien
ctcaacctttatatcgyaagtagctcacactga

SEQ ID NO: 10143 - DNA, 33 bp, homo sapien
cttctctctcagctcarcagaattgaacagaat

SEQ ID NO: 10144 - DNA, 33 bp, homo sapien
ccatctccctagacagrcaatagacataacgca

SEQ ID NO: 10145 - DNA, 33 bp, homo sapien
atgtgagaaaaaatcayatgggcttacaccacg

SEQ ID NO: 10146 - DNA, 33 bp, homo sapien
agaagcacatccctcaragtttttgtactgcca

SEQ ID NO: 10147 - DNA, 33 bp, homo sapien
gtttcttataaatacakaagtttcaggttcatt

SEQ ID NO: 10148 - DNA, 33 bp, homo sapien
gacggactgtgcttgayggtgaggtattgttcc

SEQ ID NO: 10149 - DNA, 33 bp, homo sapien
gagctatcctaacacartaagagaggaaaagca

SEQ ID NO: 10150 - DNA, 33 bp, homo sapien
tggatccatttgaacaratcagtaattgaactt

SEQ ID NO: 10151 - DNA, 33 bp, homo sapien
atatcaatcaatcaatmaataaatcccagaatg

SEQ ID NO: 10152 - DNA, 33 bp, homo sapien
cagtggctaagaaatayacaaatgttgcaagtc

SEQ ID NO: 10153 - DNA, 33 bp, homo sapien
ggttgttctttctcgayagctgttccaagagtg

SEQ ID NO: 10154 - DNA, 33 bp, homo sapien
ctgctttcagaacctakgctgagttcgagattt

SEQ ID NO: 10155 - DNA, 33 bp, homo sapien
aagagatttgactcaayttcccggttgctgggt

SEQ ID NO: 10156 - DNA, 33 bp, homo sapien
taattctaccatattgraacaggaagtcctcta

SEQ ID NO: 10157 - DNA, 33 bp, homo sapien
aacatgctaaacctaasaacaattaattcactc

SEQ ID NO: 10158 - DNA, 33 bp, homo sapien
gattctgcacattatcratattaacagctccag

SEQ ID NO: 10159 - DNA, 33 bp, homo sapien
acatcacctgggtatcrgactcagctacatgtc

SEQ ID NO: 10160 - DNA, 33 bp, homo sapien
actgctgacggttgatraaggggcactgagaca

SEQ ID NO: 10161 - DNA, 33 bp, homo sapien
aactccttgaagcgacsgcatgttacaatctgg

SEQ ID NO: 10162 - DNA, 33 bp, homo sapien
cctcagagtccagtgasctccagttatcacccc

SEQ ID NO: 10163 - DNA, 33 bp, homo sapien
gtaatgaattcctaaaygctggaaatgacaaga

SEQ ID NO: 10164 - DNA, 33 bp, homo sapien
tgaacctcaggaacaamgaactactttccagca

SEQ ID NO: 10165 - DNA, 33 bp, homo sapien
taattgtacctataaaktcacaacgctgtaatc

SEQ ID NO: 10166 - DNA, 33 bp, homo sapien
gcaaaaacgggtctcarcatgccttcccagagc

SEQ ID NO: 10167 - DNA, 33 bp, homo sapien
tctacacctctctgtcraagaattgtgatgaat

SEQ ID NO: 10168 - DNA, 33 bp, homo sapien
aggaactttactggacracgtatcccacatgaa

SEQ ID NO: 10169 - DNA, 33 bp, homo sapien
gaaaacttacagatacratgaaggctgctttga

SEQ ID NO: 10170 - DNA, 33 bp, homo sapien
aaggtgacttacctgamgggtcccgttccttct

SEQ ID NO: 10171 - DNA, 33 bp, homo sapien
ggcaggcggtcaacacragccacttgtaacaca

SEQ ID NO: 10172 - DNA, 33 bp, homo sapien
tgaatgaaatgtcacaygccgcaaggacaagga

SEQ ID NO: 10173 - DNA, 33 bp, homo sapien
tctaatttggtaatgawgaatgagtaatagaat

SEQ ID NO: 10174 - DNA, 33 bp, homo sapien
tgccaaactgataaaawggattcactgaataac

SEQ ID NO: 10175 - DNA, 33 bp, homo sapien
aggcaggtcccagaaasagccagttgcagggtg

SEQ ID NO: 10176 - DNA, 33 bp, homo sapien
agactgattctgtccartgaaatgtgatgtcca

SEQ ID NO: 10177 - DNA, 33 bp, homo sapien
aataaagtagggtcaarcatgaatgaacaacac

SEQ ID NO: 10178 - DNA, 33 bp, homo sapien
ccacctctgcgacaagmactgactcatgcccga

SEQ ID NO: 10179 - DNA, 33 bp, homo sapien
cagtggtggagaaaagwatccctttgaatgata

SEQ ID NO: 10180 - DNA, 33 bp, homo sapien
caagtgtggaatttcayctgcgcgtcagggtgg

SEQ ID NO: 10181 - DNA, 33 bp, homo sapien
attcatatcctcctcasgttaactagcatctat

SEQ ID NO: 10182 - DNA, 33 bp, homo sapien
ccactgcgctcgaccayaaacgtcactcttagt

SEQ ID NO: 10183 - DNA, 33 bp, homo sapien
cctacctagtacacatyatctacaatataacat

SEQ ID NO: 10184 - DNA, 33 bp, homo sapien
cctagccctactggacrctctgttcttgacact

SEQ ID NO: 10185 - DNA, 33 bp, homo sapien
gagaagtgaggcactgsaattaaaaacaaacaa

SEQ ID NO: 10186 - DNA, 33 bp, homo sapien
gtggttctctgtcatcyatcaagtctcccaggg

SEQ ID NO: 10187 - DNA, 33 bp, homo sapien
tcagaaaacacacgaarccatttcatgtccaga

SEQ ID NO: 10188 - DNA, 33 bp, homo sapien
agttggtaacactaagkctggaaagatgaaatc

SEQ ID NO: 10189 - DNA, 33 bp, homo sapien
caacacatagtcagaartattcagaaatgtaag

SEQ ID NO: 10190 - DNA, 33 bp, homo sapien
atgataatatttatagkccattttcatttataa

SEQ ID NO: 10191 - DNA, 33 bp, homo sapien
atgaagatggtagtaayaatggctaacattgat

SEQ ID NO: 10192 - DNA, 33 bp, homo sapien
ataagtagcagcaaaartgtcagcagagcttac

SEQ ID NO: 10193 - DNA, 33 bp, homo sapien
tcatcttcaggaatacygcatttaacaacaatc

SEQ ID NO: 10194 - DNA, 33 bp, homo sapien
caggtggtctgaaggayaccacaagaagctaac

SEQ ID NO: 10195 - DNA, 33 bp, homo sapien
atctctcagagtggtgraaccttgggaatagat

SEQ ID NO: 10196 - DNA, 33 bp, homo sapien
tctttcctgctctcccrcaaaagctgtattatg

SEQ ID NO: 10197 - DNA, 33 bp, homo sapien
ggtctgaaagtgcaacrgccaaagggagagagg

SEQ ID NO: 10198 - DNA, 33 bp, homo sapien
tttttacttgttgttargatagagtgataacca

SEQ ID NO: 10199 - DNA, 33 bp, homo sapien
gctgccttcagccaaaycttattcgggagcatt

SEQ ID NO: 10200 - DNA, 33 bp, homo sapien
ctgagatataggattcraaagcaaaatacaaat

SEQ ID NO: 10201 - DNA, 33 bp, homo sapien
taaggaagtgctttcartaagaggggtaagaga

SEQ ID NO: 10202 - DNA, 33 bp, homo sapien
ttgatcaaatctaacaycacttatgataaaaac

SEQ ID NO: 10203 - DNA, 33 bp, homo sapien
tgctttttatcctcttkttcttccacagaagga

SEQ ID NO: 10204 - DNA, 33 bp, homo sapien
ctgcagagaccctgtgrgcaacaggccttgtga

SEQ ID NO: 10205 - DNA, 25 bp, homo sapien
tcatttaacatttgtgttaacaaaa

SEQ ID NO: 10206 - DNA, 25 bp, homo sapien
tcatttaacattagtgttaacaaaa

SEQ ID NO: 10207 - DNA, 25 bp, homo sapien
atttaacatttgtgttaacaaaaac

SEQ ID NO: 10208 - DNA, 25 bp, homo sapien
atttaacatttgagttaacaaaaac

SEQ ID NO: 10209 - DNA, 25 bp, homo sapien
tttaacatttgtgttaacaaaaact

SEQ ID NO: 10210 - DNA, 25 bp, homo sapien
tttaacatttgtcttaacaaaaact

SEQ ID NO: 10211 - DNA, 25 bp, homo sapien
ttaacatttgtgttaacaaaaactc

SEQ ID NO: 10212 - DNA, 25 bp, homo sapien
ttaacatttgtgataacaaaaactc

SEQ ID NO: 10213 - DNA, 25 bp, homo sapien
taacatttgtgttaacaaaaactcc

SEQ ID NO: 10214 - DNA, 25 bp, homo sapien
taacatttgtgtaaacaaaaactcc

SEQ ID NO: 10215 - DNA, 25 bp, homo sapien
catttgtgttaacaaaaactcctcc

SEQ ID NO: 10216 - DNA, 25 bp, homo sapien
catttgtgttaagaaaaactcctcc

SEQ ID NO: 10217 - DNA, 25 bp, homo sapien
tcatttaacatttgtgctaacaaaa

SEQ ID NO: 10218 - DNA, 25 bp, homo sapien
tcatttaacattagtgctaacaaaa

SEQ ID NO: 10219 - DNA, 25 bp, homo sapien
atttaacatttgtgctaacaaaaac

SEQ ID NO: 10220 - DNA, 25 bp, homo sapien
atttaacatttgagctaacaaaaac

SEQ ID NO: 10221 - DNA, 25 bp, homo sapien
tttaacatttgtgctaacaaaaact

SEQ ID NO: 10222 - DNA, 25 bp, homo sapien
tttaacatttgtcctaacaaaaact

SEQ ID NO: 10223 - DNA, 25 bp, homo sapien
ttaacatttgtgctaacaaaaactc

SEQ ID NO: 10224 - DNA, 25 bp, homo sapien
ttaacatttgtggtaacaaaaactc

SEQ ID NO: 10225 - DNA, 25 bp, homo sapien
taacatttgtgctaacaaaaactcc

SEQ ID NO: 10226 - DNA, 25 bp, homo sapien
taacatttgtgcaaacaaaaactcc

SEQ ID NO: 10227 - DNA, 25 bp, homo sapien
catttgtgctaacaaaaactcctcc

SEQ ID NO: 10228 - DNA, 25 bp, homo sapien
catttgtgctaagaaaaactcctcc

SEQ ID NO: 10229 - DNA, 25 bp, homo sapien
ttttgttaacacaaatgttaaatga

SEQ ID NO: 10230 - DNA, 25 bp, homo sapien
ttttgttaacactaatgttaaatga

SEQ ID NO: 10231 - DNA, 25 bp, homo sapien
gtttttgttaacacaaatgttaaat

SEQ ID NO: 10232 - DNA, 25 bp, homo sapien
gtttttgttaactcaaatgttaaat

SEQ ID NO: 10233 - DNA, 25 bp, homo sapien
agtttttgttaacacaaatgttaaa

SEQ ID NO: 10234 - DNA, 25 bp, homo sapien
agtttttgttaagacaaatgttaaa

SEQ ID NO: 10235 - DNA, 25 bp, homo sapien
gagtttttgttaacacaaatgttaa

SEQ ID NO: 10236 - DNA, 25 bp, homo sapien
gagtttttgttatcacaaatgttaa

SEQ ID NO: 10237 - DNA, 25 bp, homo sapien
ttttgttagcacaaatgttaaatga

SEQ ID NO: 10238 - DNA, 25 bp, homo sapien
ttttgttagcactaatgttaaatga

SEQ ID NO: 10239 - DNA, 25 bp, homo sapien
gtttttgttagcacaaatgttaaat

SEQ ID NO: 10240 - DNA, 25 bp, homo sapien
gtttttgttagctcaaatgttaaat

SEQ ID NO: 10241 - DNA, 25 bp, homo sapien
agtttttgttagcacaaatgttaaa

SEQ ID NO: 10242 - DNA, 25 bp, homo sapien
agtttttgttaggacaaatgttaaa

SEQ ID NO: 10243 - DNA, 25 bp, homo sapien
gagtttttgttagcacaaatgttaa

SEQ ID NO: 10244 - DNA, 25 bp, homo sapien
gagtttttgttaccacaaatgttaa

What is claimed is:

1. An array of oligonucleotides, the array consisting of:
a plurality of probe sets, wherein each probe set consists of a plurality of different sequence oligonucleotides attached to a solid support, wherein each different sequence oligonucleotide consists of 20 to 33 contiguous nucleotides of a different sequence listed in SEQ ID Nos. 1-10,204, wherein each probe set consists of probes consisting of 20 to 33 contiguous nucleotides of one of SEQ ID Nos. 1-10,204 and where the plurality of probe sets consists of probes consisting of 20 to 33 contiguous bases from each of SEQ ID Nos. 1-10,204 and wherein each different sequence oligonucleotide is attached to a solid support in a determinable location of the array.

2. The array of claim 1 wherein each probe set consists of a plurality of perfect match probes for a first allele of each SNP and a plurality of perfect match probes for a second allele of each SNP.

3. The array of claim 1 wherein each different sequence oligonucleotide is attached to a bead.

4. An array of oligonucleotide probes wherein the array consists of a plurality of probe sets, wherein the plurality of probe sets consists of a probe set to interrogate each of the SNPs at position 17 of each of SEQ ID NOS 1-10,204, wherein a probe set comprises one or more probe quartets, wherein a probe quartet consists of a perfect match probe for each allele of each SNP and a mismatch probe for each allele of each SNP and wherein each perfect match probe consists of between 15 and 33 contiguous bases of one of SEQ ID NOS 1-10,204, or the complement thereof, and each mismatch probe is identical to a perfect match probe but for a single base chance, and wherein the probes are attached to a solid support at known locations.

5. The array of claim 4 wherein each probe is attached to a different bead.

6. A kit for genotyping each of the SNPs present at position 17 of each of SEQ ID Nos. 1-10,204, said kit comprising: a plurality of oligonucleotides, wherein each oligonucleotide in the plurality of oligonucleotides consists of 15 to 33 contiguous bases of a sequence from SEQ ID Nos. 1-10,204 or the complement thereof, wherein said plurality of oligonucleotides consists of oligonucleotides consisting of 15 to 33 contiguous bases of each of SEQ ID Nos. 1-10,204 or the complement thereof and wherein each different oligonucleotide is attached to a solid support in a determinable location.

* * * * *

UNITED STATES PATENT AND TRADEMARK OFFICE
CERTIFICATE OF CORRECTION

PATENT NO.       : 7,629,164 B2
APPLICATION NO.  : 10/891260
DATED            : December 8, 2009
INVENTOR(S)      : Matsuzaki et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1068 days.

Signed and Sealed this

Second Day of November, 2010

David J. Kappos
*Director of the United States Patent and Trademark Office*